United States Patent 7,745,391 (HUMAN THROMBOSPONDIN POLYPEPTIDE) - sequence listing, part 8

SEQ ID NO: 18217 - DNA, 281 bp, Homo sapiens
acgtcgacactggaagtcctagccagagtaatcaggcaaggaaaataaatacaggcatctaaacaggaaaagaagaagtaaaacaatctttgttcgttgacaatatgattttatacctagaaaaccataaacactctgacaaagttctcctagaactgataaatgacattaataaaatctgaggatacaaaaccaatgtacaaaattcaatagcatttctatagatgaataatatccaggctgataataaaatcaagaacataatctcacttaaaattgcc

SEQ ID NO: 18218 - DNA, 523 bp, Homo sapiens
ctgatttcagaatgtcaaggttctggttttgactctgtagcctgggccgagtcacggccagtgggtcccaattttcttgcctatacggtgaaagtttttgtaccacttgctttctgaagcgccttctggttccaggtttctgtaaggggtaaacgatttttgtgactctatgaacagtatttaacatgtatgggagtaaaaaggaagaacctgtttcctgttctccaacatttatttcttttaccccttgttaagttggtcatcaaattgaaaggttttaatgttctttcattctaggaaatggctgtgagattgtttctaagtatattaaaggtaatgtctcttttctaaacctttgcttttgctgataattgtggagagaagaaccagaacaggcactgaattcccattcctaaagccaacgctctaattcggcctccatttcattagctctgaccggaagcatgttgcctgcatctgtaaaaattataaatcaaaataaaataactttggcgactatttt

SEQ ID NO: 18219 - DNA, 494 bp, Homo sapiens
gcgagggataccagaaacctttaatccagatcattcctgttttccattcaattggtggtggtttgcctaggaccccaaaactgtacttgcagatgaacttactacttttcttcctaatggcatcttcagacttagaactaaatctcagacttcagttgcttcccttaataactgaaaatatactgcattatattccttgtccttcaaagtagcttttgatgtgttggcccaacgggtcttttcagaaataccgtgcgtggatgatttgtagtaaaactgagatgctgtatattttccaagtaccagattcacaaggaataatgcgataatgatgccttgttttctcaagctttcagacgtgccggcctagagctggcaacatgcaatctcgtactacttcatctgaattactgaaatgggagacttctgtctgcattctattactgatttccgtgtttcacaacctgcagtttcctagtcttcaggggtaaagg

SEQ ID NO: 18220 - DNA, 463 bp, Homo sapiens
caaatatgtataattattacatgtcaactaaaaagaggaacaaatatatcaataaagtatacaaaccttaagttgtacaacgcaatgaatatttaacacgcaagtataaatactcataaaaataccacacaggttaacatgtagaatattttaagcacttcatgagtctcccttgtaccccttcccagtttatacccccaaccgaagataatcatgcttctcaattctcatcatcatatattagttttcttatttctgcattttatataaatggatgtcctgctttgtatctaacatcatgtattcaacattatgattgtgggattcatcaaatttttgttgtttatttttttcattgctttgtgttattctagtgtatgaatttgcaagtgtttctttatctgttatcttttcatggacatttgatttgtgtccagtgttggacaatatgtataaagctgct

SEQ ID NO: 18221 - DNA, 342 bp, Homo sapiens
aaagaatctttaaatacggagtcgaaggcaaataatcaggagtgttactagcaaaccctgagcttcaaaacagaaattcgagcttccatggttgcttaaaaagatacaactttgcccttctggcttctggctcgtccacacatctgcatgtgccctaaggtccctctgctgcagagctctggcagcatctttgctttccagatccaaaacaaaaacacaaagaaaaggggaatcccgatcagaaccagaaatagaatgcgtattctcttaagaatgggttcgagggtgttcaagtactttaacatatgtcataataaagttcttctactgattgaaaggcac

SEQ ID NO: 18222 - DNA, 874 bp, Homo sapiens
acggcttatcaaagtcaagcactgtgtcacctggtaatgcaaacccttccagcatctctgcctttaggttttaggggggaatcgtcaaaacagacatgcagcccactacaaagtacttgaaagcaatagggcaccattcaagcacacgcctgcatttactgggctacgtttatttagggcattcaggtggctgtaattattgtgcataaatagttttctaaaaagcataaaactaaaaacttgatccatggaaacacagtgtggttttaggatggagatcggatttcactcacctcaaaataactcctggtgtttgcctccaagacccattaatttatgttatctcttgctctgtagcagtttggatttgtcacacttagcaaagtaatttggtttcccacaggttttgttctgttttatagaagcaagagaacggttttgtgtttcagagcatgaatacattccttcagaaatttagccagcatttcagaaggatatgaatttttatttttagctatttacacctgcctgaaaggttgatgctgctaaacattgatattacttgaaaagttgtgcccaaggcatattgcttctttcctagctaggaattgaaatgtttatgaagcttgctgaaaatttaccaggttaccaaaataagagtttatatctcttatgtagtgactaacagaaatagatttatgtattcaaccaaccgtccaatatttattaagccactaatatatgcattgaattatgctggatttggggtgacatcagattatacaacatacacttctcctgttccagttcccttttaacatgttattactgggcacttacagaatgacaaaatcacattaataagactcaggcc

SEQ ID NO: 18223 - DNA, 339 bp, Homo sapiens
agccctcctcaggggtttgtcctctagacccgtactcccaaactgtcaggcaggccttatctttcttcccaatttttggccaccttttaacatccccatcagtctcagtagcctcctcaacaaacaggtctaggagttatttcctccttattgaccccacggtacaggcagatgggttcctggcattccggatcttaactaaagccaaattttcccatagagtgacataaataataatatacgcccaagttttatagaagtatctttatacatgaaatgtttgagcaaaatgaatctgtaggttgatcaaggaacaaaataacctctttttttaattta

SEQ ID NO: 18224 - DNA, 119 bp, Homo sapiens
tccacccaaagcacacacttggttttttaaaaagaaaaaaatgaatacaaaatagtgacttttcctgtggaccatttcaatatgatttgaaccgtcaataccaaccccctaaccccagt

SEQ ID NO: 18225 - DNA, 791 bp, Homo sapiens
agttattctatgtcaggtattgctccaagtgctttatatgcaaatatatgtattaaatgtatgtaatagatgtttcacctcatttaatgcttgctacatggtctgtattaactagagtgggggctcaataactccaagcaatgcctttctattgcaacctgaagagggagattagaaatgtagaaaccatccattcatatctctccctcatttaatagctgaggacactaaggcccagagagtataatcatttggccaagggtacacagcatggcagtaggtgccagagccagggcagagtctcccaggctcacatcaaagggtcgtttctgtggagccaggaggtgacattgggatgaagggaaggctttccctcatccatagggttctcaggtcaaacccacccaaaccagccaggttgtgggcctcccaaaaaacaaaaaaaaatggtgtgaaacctttaataacagatggtccaaacctggggagaataagataaagctaacggtagttacagatgagacatgttagtgtaggatttgactgcatgtggtttgagggacatgcacaggcctcttgtcaactggattccacatactaaaggagtgtgctgggcagcccccgactcacaaacggggccatcagcctttcctagcaaggctttgtttcagaacttggcatgcattttcctataaaaacaaggtggtaacctgtgatttggttctcccgccaacccacaaagccctgtttaaccctagcagacctgggccttcttattaatggtggtttct

SEQ ID NO: 18226 - DNA, 178 bp, Homo sapiens
ggaaaattcattttagtttttaatctgaactgtctcagctggggatgtggtatggcagagaggtgtatgcccataatttaataaaggaatacttatttttgtatgtttataagattgcatctctttatgccagtctctcttcacttgttttgtaatgtaacgcgagctctttctagtt

SEQ ID NO: 18227 - DNA, 366 bp, Homo sapiens
tcagtcatctactttgttctacatgttattcttaaggttataaataaatttagagaatcttcatagaaacaacctagcagtgttatttttagttttaaaaaaacaagaagctgataaaacaatgcttgttttctaataaagttaaaatgagaccagcctggatacaacatagtgagaccccacctctacaaaaaaatttttttaaatgagccggatggggtggtaagcacctgtagtcccagctacttgggaggctgaggtaggagagtcacttgtatttgagaggtcaaggttgcagtgagccatgatcatgccactacactcaagcctgggcatcagaaacagaccctatctttaaaaaaaaaa

SEQ ID NO: 18228 - DNA, 252 bp, Homo sapiens
ggcttcctcacctcttaaataagaacttggactggatgtatttaaacctggctgcaagtcagcaatttccagggagcttcagaaatacagatttcccagacccaggaacctgtatttttaggaaagtctccaagagattctgatgcagccagtcaccaggtagggcccacttgactcagtggtgacctgagttcctttgaattctcatgtacctgaattcatgtaaaaggatgagctcaagttgctaaactt

SEQ ID NO: 18229 - DNA, 426 bp, Homo sapiens
ggctctttcttctgcattcattgaaatcatttcaaagttttctctatgctaggaattagatattttatcagtgtttgttttgttctttgatatttccattcttactattgaaattatctttgtccttggtttttatttcttaatttctctaacctttttcatctagtcctgttgtgtcaccatttcatccttgagctcttttttatttcatgcagtaattcagcactctgcatctgtgctcactctccttaactctagtttccatagagcagcagaggatcccatggagctgacgatcagatcatgccactttctctgctcaactcctgcagtggcactgggtgcagtgggctcacatctgtaatcccaccatttttggaagccaaggctggaggatcacttgaggccaggagctcgagaccagcc

SEQ ID NO: 18230 - DNA, 394 bp, Homo sapiens
gaggtgggaagactgcttgagtccaagagtttgaggttacagtgagctatgatcacgccacttgcactccagcctgggcaacagaagaagaaaaataaaaaataaaacagatggcaatggattatagcacttcatataaggccatgagcctacaatgctatcagaaggaaaaaagatggtgagaggtagggagttgtgaatacagagagaaatctcttctttacagagagaaagaatttcagctaataagtgtagaaacaataatacaattagacaaatcaccattttgctacctctcccacctctccataataactacttcaggcaaggatcatcaaagatgctaaaacaaatggacaacaggttattgggaaagaggttattcctcctacct

SEQ ID NO: 18231 - DNA, 368 bp, Homo sapiens
ttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgccccacattccac

SEQ ID NO: 18232 - DNA, 1501 bp, Homo sapiens
aataagctagtagaggcgggggtgaatcggacgagggctttcgctttctgccatgactgtgaggcctccccagccatgtggaactggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18233 - DNA, 1013 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagtagagacaagggtgttgctgtgttggccagggtggcctcgaactgctggcctcaggagaacctcctgcttcagcctcccatagtgctgagattataggtgtaagccactgtacccaacctaccactattcctgaatactctcatcaccctgtaaagaaaccccacactctttgagcagtacctctgaggaaaaaaagaaactgcatgcttattagcagtcactccccattcctccctccctccagcccctgcactaatctactttgtctctacagtttccctaaccgggactgactttcatttaaacggtatcatgta

SEQ ID NO: 18234 - DNA, 889 bp, Homo sapiens
gagatagttatcagtcgtcccgttggatttcgtcacgggggctgtaagatgtgcctttcgctttctgccatgactgtgaggcctccccagccatgtggaactggtgcagcagaagacccccagacggccctggcactgaacttcggctctacgttgatgaagaagaagtctgatcctgagggtcccgcgctgctcttccctgagagtgaactttccatccggataggtagagctgggcttctttcaggcaagctctttgctgcagacactgagctgagtcaggcaatatggacgtgggggctggtggtaggatgaatagtgagagaaatgccagcactgtcctatccctccgaatcactcaccctactactgcatggagctaaactggcatctggcccagcaccttcatttctcatttgttgtccaaaccacatgcttagtctacagaagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccaggtttccatttagctgcaagaaacagcactgtatttttcaaagcactagaaaattctgtggccagtccagaaagacaaaacatagcaccagtgtggcaagaagtggagctaatgcagcattaatgatcctggatgtttctgcactttcttattagaatttaccattcacctctaagcttcagctctgcagtgccccctatttgggattattgagcaatgtttaacgggaaagaaatgatgtctgttctccagccagtgactctgagtaa

SEQ ID NO: 18235 - DNA, 841 bp, Homo sapiens
ttttcatgtatcatgaaatagtcattgttttttcaattacttacaaaatacaaaaatcattcctaggttgcaggccatagagaagaaggcagcagccatttggcccccatgacttagtttccctgggtttaagctgctgttacgatgattttctttgactggcagcctcatgcagtcctacttaatgcagtgacagtgatggtgatgttccttatggggaaatattcctaacccctcttgcttttcttacatctatttcagagggtctcgctgttggagttggatttggggctatagaaaagacggcatctgctacctttgagagtgccaggtaagccagcatcctgggaccctagagcatggttctgcacccaggggtgctctgggtgtgcgtgtcacctgggtgggctgtctgtgcattattgttcagcaccccagccccacaggaccaagactgatggaggccacatggggtccggtgaaggccatccctgagagaggagtctcctaagagaggagtctttcaactgagctattaagtgggtgatgatcattttggaaacaaagcatggatagaatcgcaagctgtactctaagcacttcaaaggtgtgaagactaatgacaaaaaacaaaggcagccgctgacactcttcaggcctttcctttttgaagccctccctttgtctttcttgatgctagggtcccttcgtttccctctctctttccacctgctcctggaaaggccctttggtggtgggcttgtcatcctatggcctgttcttaagaggtgatgttcccagggacctgtatccagagcatccttccttctcactgaacaca

SEQ ID NO: 18236 - DNA, 731 bp, Homo sapiens
tttatttcagtgtaccgggactggtgtgtaatttgtatttatgtggccgcttggtagtacacattcccagccatgtggaactggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcaggttggagaaccttccctccctgtctg

SEQ ID NO: 18237 - DNA, 1837 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18238 - DNA, 1498 bp, Homo sapiens
gtgttagggcgcggttatttcgtcggggacgggtcatgtatttctggcgtgattggtcaggcctccccagccatgtggaactggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18239 - DNA, 1816 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18240 - DNA, 1742 bp, Homo sapiens
gagatagttatcagtcgtcccgttggatttcgtcacgggggctgtaagatgtgcctttcgctttctgccatgactgtgaggcctccccagccatgtggaactggtgcagcagaagacccccagacggccctggcactgaacttcggctctacgttgatgaagaagaagtctgatcctgagggtcccgcgctgctcttccctgagagtgaactttccatccggataggtagagctgggcttctttcaggcaagctctttgctgcagacactgagctgagtcaggcaatatggacgtgggggctggtggtaggatgaatagtgagagaaatgccagcactgtcctatccctccgaatcactcaccctactactgcatggagctaaactggcatctggcccagcaccttcatttctcatttgttgtccaaaccacatgcttagtctacagaagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18241 - DNA, 1432 bp, Homo sapiens
gttccgtttttccctattcggttcatcttatatgcaaacgagttctcgatagttgagcgtaagcaggcatcaggttacaggcctgctgcctctcagggtctcctagtagaaagactacagatgtttccctgtggggttctacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagag

SEQ ID NO: 18242 - DNA, 1275 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggtaagccagcatcctgggaccctagagcatggttctgcacccaggggtgctctgggtgtgcgtgtcacctgggtgggctgtctgtgcattattgttcagcaccccagccccacaggaccaagactgatggaggccacatggggtccggtgaaggccatccctgagagaggagtctcctaagagaggagtctttcaactgagctattaagtgggtgatgatcattttggaaacaaagcatggatagaatcgcaagctgtactctaagcacttcaaaggtgtgaagactaatgacaaaaaacaaaggcagccgctgacactcttcaggcctttcctttttgaagccctccctttgtctttcttgatgctagggtcccttcgtttccctctctctttccacctgctcctggaaaggccctttggtggtgggcttgtcatcctatggcctgttcttaagaggtgatgttcccagggacctgtatccagagcatccttccttctcactgaacaca

SEQ ID NO: 18243 - DNA, 1073 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagacgtgtttgcttcaccttctgccatgattgtaagtttcctgaggcctccccagctgtgtgaaactagggtctcgctgttggagttggatttggggctatagaaaagacggcatctgctacctttgagagtgccagggtcttgaacttggtttcctgccctggacttaacctgccttcctgacaccgactgacttcacctctccccatgccctcatgtcatgtcttatctgttcctattgtggatccgggattccttggcctgtcccttggcctgctgctgatcatatctccactctgacccacaatatagattttcaaggtaaaaatttttttaaaaaatgtttcactctgttgtctagtaaaatacatgaatgtgta

SEQ ID NO: 18244 - DNA, 1008 bp, Homo sapiens
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacggccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccagggtcttgaacttggtttcctgccctggacttaacctgccttcctgacaccgactgacttcacctctccccatgccctcatgtcatgtcttatctgttcctattgtggatccgggattccttggcctgtcccttggcctgctgctgatcatatctccactctgacccacaatatagattttcaaggtaaaaatttttttaaaaaatgtttcactctgttgtctagtaaaatacatgaatgtgta

SEQ ID NO: 18245 - DNA, 709 bp, Homo sapiens
aataagctagtagaggcgggggtgaatcggacgagggctttcgctttctgccatgactgtgaggcctccccagccatgtggaactggtgcagcagaagacccccagacggccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccaggtgaggtcttgcccgtgagcgtgacagccactgcctgaaggtttccatttagctgcaagaaacagcactgtatttttcaaagcactagaaaattctgtggccagtccagaaagacaaaacatagcaccagtgtggcaagaagtggagctaatgcagcattaatgatcctggatgtttctgcactttcttattagaatttaccattcacctctaagcttcagctctgcagtgccccctatttgggattattgagcaatgtttaacgggaaagaaatgatgtctgttctccagccagtgactctgagtaa

SEQ ID NO: 18246 - DNA, 337 bp, Homo sapiens
cttcctagcacccacggaggtcttggcctcggccagggactcccattgtgtgagcacctattccagacagcagccttcatgtgctttcttggtttttcaggaatttggccattggaatcgggatccagaatttccccgagggcctggctgtcagccttcccttgcgaggggcaggcttctccacctggagagctttctggtgagtgctgcccaagggcaaggccatgtcacagcatcctccatgtgggcttctttcaacaaaacagtgatgtgcttttgcactgccatgctcagatatgacgtagaatggcatgcatccatgtgctagggttgagcc

SEQ ID NO: 18247 - DNA, 858 bp, Homo sapiens
agaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaactactaaa

SEQ ID NO: 18248 - DNA, 984 bp, Homo sapiens
agaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcggtgagccccccggccagggtccaggccgcgcctggggaaagagcagggcggacctcggggcccaaggacacctgtattccagatggagaactctgcggctcaaagagggaaagggagcaacccaagcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaactactaaa

SEQ ID NO: 18249 - DNA, 688 bp, Homo sapiens
agaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgtgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaactactaaa

SEQ ID NO: 18250 - DNA, 1343 bp, Homo sapiens
tgcccagatcggcagccgctgctgcggggagaagcagtatcgtgcagggcgggcacgctggtcttgcttacagttgggcttcggtgggtttgaagcacacattagggggaaatggctctgttcctgcaggtttgcgcagtctgggtttcttaggtttagggggttgggtgggtttctctgggggtgcggtgggaagcggatcagttcggataacggccctgagcaagagtctctgtcccgctcccggcctgacgcggggcttccagcggacaccaccgacgattttataggttcagaaagtgtgtctcagaggagttagagaagaccgattaatagatgacagtgctaaagcctggatctcctgaatcctggatgaaagtgtcctaagttagattcctgggaagaaaattctgagacacattctgcaggatgattattagggctcatccttggtttcaacacccatagaaggaagggggaagaagaaatcgaacagagagacagaagtcgagatgcatttcaggccaggactcttggctgaacccacaggagctctggagctagaatggcccttcagagttgtcctgagttggtctgagatggccagttctttatattcctgcatgggatagtcactggatgtccaccccaggaaggggtgtggccaagacagtccctaaaatgcccgccagcactccctacacctggagcgacaagaccaacatcacagggggaatgcactgggtgatggatcacagcgttcatcccagaagatgaggatacagaattggctgacaactacgttctaaatgtcagtgttctccaaaattcatatgttgaaacttaattcccaatgtgatggcattaggaagtggggcctttgggggagggactataggtcatgagggtgtaaccctcatcaatgggattagtgtccagagagctgccttgcccttccaccatgtgaggacatagtgagaaggtgccatctatgaactaggaagtgggcgcttaccaccagacacccactcttctggcaacttgatcttgaatttcccagcctccagaactctgagaaatcaatttctgttaattataagctacccagtcgatagcattttgttaaagctgctggaactaaactaagacactgacgctttctgcgacaaaaagatagagtgagtctctatagcataccatgtaacagatgtttttggaaaaataacctcatttcatatgtttcctcaagataaaaagaatgtcataacaacaaatgagaaaatagttgctttagaaatattgcaccctatggagagagtattttggattttggttttttgttt

SEQ ID NO: 18251 - DNA, 1332 bp, Homo sapiens
agggtgtgtgccgcgcgcgggaaacgccgttctccgctccaggcgtcggcgggcggtggcgagagcagattttataggttcagaaagtgtgtctcagaggagttagagaagaccgattaatagatgacagtgctaaagcctggatctcctgaatcctggttctgggatacatgtgcagaatgtgcaggtttgttaataggcatacgtgtgccatggtggtttgctgccccttcaacccgtcatctagattttaagccccgcatgcattagtttgggggaagttctatgaaatctaagttgatgaacattattccccctgctgataccaaaagtcctgacttgtaaggaggacaaagctgagatgaaagtgtcctaagttagattcctgggaagaaaattctgagacacattctgcaggatgattattagggctcatccttggtttcaacacccatagaaggaagggggaagaagaaatcgaacagagagacagaagtcgagatgcatttcaggccaggactcttggctgaacccacaggagctctggagctagaatggcccttcagagttgtcctgagttggtctgagatggccagttctttatattcctgcatgggatagtcactggatgtccaccccaggaaggggtgtggccaagacagtccctaaaatgcccgccagcactccctacacctggagcgacaagaccaacatcacagggggaatgcactgggtgatggatcacagcgttcatcccagaagatgaggatacagaattggctgacaactacgttctaaatgtcagtgttctccaaaattcatatgttgaaacttaattcccaatgtgatggcattaggaagtggggcctttgggggagggactataggtcatgagggtgtaaccctcatcaatgggattagtgtccagagagctgccttgcccttccaccatgtgaggacatagtgagaaggtgccatctatgaactaggaagtgggcgcttaccaccagacacccactcttctggcaacttgatcttgaatttcccagcctccagaactctgagaaatcaatttctgttaattataagctacccagtcgatagcattttgttaaagctgctggaactaaactaagacactgacgctttctgcgacaaaaagatagagtgagtctctatagcataccatgtaacagatgtttttggaaaaataacctcatttcatatgtttcctcaagataaaaagaatgtcataacaacaaatgagaaaatagttgctttagaaatattgcaccctatggagagagtattttggattttggttttttgttt

SEQ ID NO: 18252 - DNA, 480 bp, Homo sapiens
tattagtcccagaagatttatgttaggaaagtgagttatatgagccagtgacttgtctggattagaggtggtaaaccatcagcctataaaaaagaaaatacggtttgtgggcacgttttgtttagtctgcagggtattgatccactaagggatttttttcaaaaacataagctgatttctacaaagataaacaatgaaccagcattagggtgatggagacatttgtgtgttccacttttctgcatgacataatcggctgcagcaaaggagcagctgccttttatgggtttgtggtcaagcgagtttaaacacctggtgctttttacccctctgcactgggctcctacagacatttctatgtatttatgatcctagtcgtgatgtttacttagatttccttttggttctgtgattctttgtatttatcgtatgtttctcttgccctcactcactttttaatgcgtatgtatgtgtgtggcc

SEQ ID NO: 18253 - DNA, 952 bp, Homo sapiens
ggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcacaagttataagggagaaggtcggcagcagatttgtaccaggagccacgagtcagacccacttcgtgaccccctcaccgaaggaacgcgttccaactgcctccgtccatactggtggcgaacgctcgccacgcaggaccagggtacccatgtccaaccgtattcggcggcattcaaaacccggcaaacctcgcgcgacggttggtgccaacgcgccccgcgcacatccgagcggacgaccaaacaccgcgcaggcacacaacgagcgccacagggcccaggtcaccgccacatcacga

SEQ ID NO: 18254 - DNA, 665 bp, Homo sapiens
aaatattaaatcatgttatatcaagtattttccagaaatacaaatatgaaaaggaagaattcatcattgtgatctttaattttgtggtcttcattgtttggggacaatataattgtaactcaaattatgctgcgtcaaatcattaaattaatacatttgtatatgcatgctcatatatgcacaaattgaaatatataaaaattcaaaacacacttgggtaataataaaaatctttaaggttgccataaacacaaacacacatacacacaactaagcaatcaaaaaacactagagccaggcacagtggcacatgctcatagttccagccgaaaggagaggttgagcccaggagctcgaatgaagcctggacagcataacaaaattccatttacaaaaaaaaacaaaaaacaaaaaaaacccactaaaacaacctaatcaaaaatttataaatttgaaaataatctctattaagactttgataaaatttaaaaatgctataaagacacaagtgttatacattaaggatgtaataatttgcatataggttaaaatgcaatgttttaaagaagataattcaaatagctagttctttgaaaagatcaataaaatggaaaagctgctgaaaagaaaattagaaaaagaaagaaagtaagggtatataacat

SEQ ID NO: 18255 - DNA, 467 bp, Homo sapiens
tatttctgagtaactaacattcaccctttacttttacttgcactgattggattttttaaacaccataaacattgtatttgtcccccactcccaaaagagagcaccttcatattgcttccattgctatgtctgagataggattcactttcatgtctttattcagggcacagagtgctagtcccatctggatatttttcaagttccgcagacatctttaagaattatgactgatcctaccaaaagatcggaacagcatattggcaggttacagggtttttatgagaatatatgagatcatctagtgactttacttttaaggtaggtagagtataagtacatagagaggccaggcgcagtgcatcatgcctgtaatcccagcactttggaaggccgaggcgggcagatcacgaggtctggagatcgagaccatcctggctagcacggtgaaaccctgcctctactaaaaa

SEQ ID NO: 18256 - DNA, 504 bp, Homo sapiens
ctcagttctagatgttgtagtatatatagaaaatgtatttaacatatataaatagggcgttagcctccgggacccaaatgtttagttagagatatgaggcccacgtaaaagaaaaccagcaaactaagtggcccaagtgaggccaaactggcagcacagagcccagtggaacaggccactctagtaattcttgagttcgtgagtataggccgggcacagtgactcacacctgtaatcccagcacttttggaggctgaagtgggaggactgcctgaacccaggagtttgagaccagcttggataatatagcaagatcctgtctctctctacaaaataaaaatttagaaaaattagctgggcagagtagtgcctgcctgtggtaccagctattcaggaaggtgaggtgggaggattgcatgagccccagaggttgaggctgcagtgaaacattattacaccactatactccagcttgggtgacacagcaagaccctatctcaaaat

SEQ ID NO: 18257 - DNA, 569 bp, Homo sapiens
ccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacatcatcagtttgccatgagtattgaaaaataatgtcttagaagcacagggcagagcctggcatgtagtttgtgctcagtgcacagcagacaagaaaccacatgcaccagacctgggcgggcgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtg

SEQ ID NO: 18258 - DNA, 454 bp, Homo sapiens
atgatacagataatcaagtccattttctatgaaacaagagtttttaagtggcaaattttatagacaaaatgtagaaagtataaagtagactcatgagtggggctaacgccagggtcggaatgctttctcttggttaggtcttccagcaaaaccaatcaaccaatacacatggaaaatgcatcatacaaacttttcagatcagagctggggctttgccttgtgtcagccgacgaagaactcccaaggccgttctggattgaatctcagcgtagagatatgtaatatgccaccaactttcctcccttctaccggctcctttgaaagagagtccttcacaagcagttcaaggaaaaagcacattaacaatgacaatttacacttaccagctggggtggtgaaggttaaaggcaaaccaaagtaaactgacaatgataaagaacttaaaagcctatgc

SEQ ID NO: 18259 - DNA, 338 bp, Homo sapiens
gcccagcatctcaaggctcttggttttcctctctacttctcctctctaccaagctgtctttgagggtaaaagtataggctcttctactgtgatttagctttttgtgattccattcattcatttgcatgccagctctgagccaggcactggctgggcagctgagacgcaggggtaattttggaagctcagaagagaagcacaaaatcccatgctgagtgccataatcccatgatcgtaggggcagaggagtacgaagagtaaccaagaaagactctcctggccacagggttaagggtgaatgaaggaaggcttcccctagcctggggagatgaggtggg

SEQ ID NO: 18260 - DNA, 542 bp, Homo sapiens
tttggtgtctgagaagatgcagcttctccagtctctgcaactgacggcaggaagatgggagcactcagcttcagtgttcagaagcagatttaggccaattgccataccttacgttctggagggatccaccctgacctgagcaggtgaggtcacagaaaggcttgctgtccatcacagggacaggattacagcctgctcagaagcatgttgtggtccagctcttgtgtcacttaaaaagactccagctcttctctaatattgaattcaactaatatcacagagagatgttcttaatcttctagacaaacacactgccatcagtattccccagaggccacaaacacaccctggaaccataatgccaccagtagctctaggagaacttgcaggctaatgtgcctgttgctcattgtttttaggctacatatgaaaatggaccagtttgcaataaaaatataatgcaatgatgattatcagagcattttgtatactagggaattttttaagttatctgaacatcaaattaaatataatgacaatga

SEQ ID NO: 18261 - DNA, 485 bp, Homo sapiens
atacttgattgtaaagatattattgtttgcaaatctttgtggagttttttgggggccaaattgaagcattaactcaaaagaatggcccttttcttttattgttatgttcttttcattttatttatttgctttcatacattttctaattaattttatgtttttaccaataccagccccatcactggggttctggtgaccacttaattttactgtgaagtagaagccagatgatggataagtcaagccccaatataataaagccaccttaactagttaaactgatattatagagcttagctctgactccagatatacatatataccattactttatagaacaactctctctggaatagccgtgttctctttaagccaggtatgatggtgcatgcctgtagtccagctactggggaggctgaggtgggaggattacttgagcctaggagttcaaggccaacctgggcaacactgaaaaactttgtctc

SEQ ID NO: 18262 - DNA, 873 bp, Homo sapiens
ggttctatttacacttagttatcaaagctagtcattttttaaaggaggatcatctggcttgattaaattaagtttccttaaagccacaaataaatgaaaacctacttgcacttagatgctttaaaatactgactctgactgggtgtggtggctcacacctgtaatcccagcactttgggaggccgaggcaggcagatcacttgaggtcaggagtttgagaccagcctggtcaacatggtaaaaccccccatctctaccaaaaatacaaaaaattatccaggcatgttggcacatgcctgtcatcccagctgaggcaggagaatcacttgaacctgaggcagaggttgcagtgagccgagatcagtgtgagattctgttgaaaaaaaaaattcaacttgatccaaaacaggagcaggctgcctccatggtatattcatgtcatgccagagcaagagcaagggagaatacaaggaaataaggcagacatgatagctctcctcagacaattgaaggactgtcatgatgaaggagcaattagatttactggtttagttccagaagatagattaagaacttttatttagtgatggaggacaaattttggcttgataaggaaattttgactcatttgaggaccccaaagtggaatgaactgaattgttaggcagtaaattttggccatattgttcatatagaggttagatgaccgtttgcacaagggtcggatgaggttttagacattaaattgggttcaacctgcaaggagaagcaggcagatttaggaaaagtcaattcgccctttttctgtcatatgattctgtggcactattaaattcattattatttttctaggcacctctgtcaattttaccc

SEQ ID NO: 18263 - DNA, 417 bp, Homo sapiens
ctgcctctctacagcttcatcttgctttcttcactctgctgtctctgtctgtgctccagctgcacaggcatatgcagttcctacgatatgcctccctctacaccgccacagggtctttgcacatgcagattctttagcctgtggaactgcttgctctacctgctcatctcccagttgcctccctacacctggccattctcccatatccctgctttactctgttgagaaccttcatattccagcttgaacacagttttctgggaagccttacctaatcccccaggttaaaccatgttccctttataaatccccacagcatcaggattctttcctcaactgtttttaaatacagtcagcccttcgtgtctgtgggttccccatctgtggattcaaccaacagcagatcaaaaatatttg

SEQ ID NO: 18264 - DNA, 160 bp, Homo sapiens
ccagcacagctcaccaccagcacaggccaccaccagcaccatcagcacaggccaccaccagcacagctcaccgtaccagcacaggccaccaccagcacaggccaccaccagcacaggtcaccaccagcacaggtcacaccagcacagctcaccaccagca

SEQ ID NO: 18265 - DNA, 183 bp, Homo sapiens
tgctcaactaaggattgtgagagttgagagcttgattgaacacttaagtttcataaagattacttcaaaaatatttagtatcaacaaaaatagaggtctgtattgtaggtttaaaaactcatttttaaataattatttggtggtaattcattatactaaacttctcagtttctttttattcag

SEQ ID NO: 18266 - DNA, 546 bp, Homo sapiens
tttttgacttacagcattttcaactcacaatgggtttattgggacgtagccccatcataagtggaggagctcctgtgctgtgtgtgaatggcctagcaccgtgcctggtgtacaacagacaccatcagtggttcattccctccccttttgcataaggaatcccccctctcgctgggtggagtctgtcaccttggtcttcaggctgttcctgaagttggtcatgagtgcatggtccttttgccggctcttgttgatgttttcgatcagctcctgggctctcttctgcaggatgtcaatgcttgagtccagagaggagaagtagagtcccgacttcccttccaggaccgtcagctggcaactggcactggaggtggcgacacaagggcaagaaacctgacttctcagagtacaggaagcggccaggtgtagtcgctcatgcctgtaatctcagcactttgtaggccgaggtgggcggatcacaaggtcaggagttcgagaccagcctggcaacatggtgaaacctcgtctctagtaaaaacaaaaaaa

SEQ ID NO: 18267 - DNA, 860 bp, Homo sapiens
tttttgacttacagcattttcaactcacaatgggtttattgggacgtagccccatcataagtggaggagctcctgtgctgtgtgtgaatggcctagcaccgtgcctggtgtacaacagacaccatcagtggttcattccctccccttttgcataaggaatcccccctctcgctgggtggagtctgtcaccttggtcttcaggctgttcctgaagttggtcatgagtgcatggtccttttgccggctcttgttgatgttttcgatcagctcctgggctctcttctgcaggatgtcaatgcttgagtccagagaggagaagtagagtcccgacttcccttccaggaccgtcagctggcaactggcactggaggtggcgacacaagggcaagaaacctgacttctcagagtacaggaagcggccaggtgtagtcgctcatgcctgtaatctcggcctccaaaagtgctgggattacaggcgtgagccactgcgcccagcctgatgctttcttaagtgaccttcctgtcattaacctgctgcatccctttcccaacctactgggtgatgttgaccgcctggggctacagtgtacctgcacctccttgctcccaccaggtgaggtgaatacctgttgaattatatttaaagagcatttaaagaaatgcgcacacacaaaaagttgttggtcccatgttgtacatgtaactgtaattatgtaattcaaatattgtgttaacaagtgaaatagtggcagaagagtgacagctatctaaaaagctaaacagaatgaaaaattttgagtaatatgtaatgttccgtaacttcataatattcaatgtaataaaatggaacttcagttggg

SEQ ID NO: 18268 - DNA, 820 bp, Homo sapiens
ccctcatgaaaaatttggagaagatatcagagttagtggttaacaggaaagatacttaaatttttcgtgaatttacttcccaacagaataactacaaaacaaaatttgaagaggagtccaaggcattttctggttccatacttttttcattctcctgttggataccatttctcctgtctgatccaatgctgagctcagtggtaatgaagtgccacattgtgaaaggggagcctagaacggggctgccagagagacagtctgtaattgaaagttctttcaagagaaggacttctatcaggtctgctgagggaataggagctccacctgctgacttttttatgtttgctgactctgaaagaatgcaaaacatgaagaaattgaatggtgttatttcttttgtaatttctcagtggaaatattgttttcaaaattattgataagatgtaccagtctaaccagggctttcaagaagaaaatgcaatctatagcttgttttaagagtggggattatgttggcttccctgggccagtctaaataattactttaatctggaacaacatataaattcataaattgttgccaccacgactcttagggaatcctcgacttttcaaacattgcctctctcagccataaatttacactgcgccactcgcccatgtgtgttttgttttaagaagctgtagtctcttgttacatgtagtttggaagaaatgctagatgtttttgatctaaagaagaaagatcaagtcctagtcaaactttagtattttaaagggcatagacattatttgagtatatgtcgtctgcgtttcagaa

SEQ ID NO: 18269 - DNA, 356 bp, Homo sapiens
ccctcatgaaaaatttggagaagatatcagagttagtggttaacaggaaagatacttaaatttttcgtgaatttacttcccaacagaataactacaaaacaaaatttgaagaggagtccaaggcattttctggttccatacttttttcattctcctgttggataccatttctcctgtctgatccaatgctgagctcagtggtaatgaagtgccacattgtgaaagggtaagagaactggtacaaagcgtaccagggaacaaatgaattagtacacctgtcacgtctcactcttgaaggatggcaccttctttgttaattgaaaagaaatgtaaaatgggagaaatagcaaaaaaaa

SEQ ID NO: 18270 - DNA, 444 bp, Homo sapiens
tgagatggagtctcactttgttgcccaagctggagtgtggtggcacaatcttggctcactgcaatctctgcctccctggttaaagcgattctcttgcctcagcctcccaagcagctgggattacaggcacatgccagtacccttggctaacttttttgtatttttgtagagacagggttttactatgttggccaggctggtctcaaactcctgacctcaagtaatctgcctgccttggcctcccaaagtgctgggattataggtgtgagccactgtgcccggccctcactgaaactttgaactcctaaactcatgtgatcttctcgcctcagcccctgagtagctaggactatagacaaaagccaccacacccagctaatttaaaaaattttttgtagaggtaggatctcattatgttgcccagggttagtcttacaggactgt

SEQ ID NO: 18271 - DNA, 739 bp, Homo sapiens
catctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggactgcgggctgcagctgagcggggaggagggacgccgttgctatcccctggcgggccacctactgtgtcgtcgttgccacctgcggcgcctccaacctgggcctcttccctcacccactgtgcacgtcactgagctctgagcaggggaaaacccgtccctgggccggggtgggtgtgggtgtggagggagggcccgcgtgggtggccctggtcagcgtcaggggagctccctccaatcagtttcccaccgagctgctgtctgcaggggccggaccccc

SEQ ID NO: 18272 - DNA, 539 bp, Homo sapiens
attcggcacgatgagagacagggtttcaccgtgttggctgggctggtctcgaactcctgaccgaagcgatgatccagccgcctcagcctcccaaagtgctgggattacaggtgtgagcccctgcgcccggcggaagagtcttcatgttgttttgcggcaccctgcagatctgcccctcccctccgtccctcccccgtcccgtgacctctgatgtgcgcttgtctgctgactctggggctgggggctgtgttcttccctaggactgcgggctgcagctgagcggggaggagggacgccgttgctatcccctggcgggccacctactgtgtcgtcgttgccacctgcggcgcctccaacctgggcctcttccctcacccactgtgcacgtcactgagctctgagcaggggaaaacccgtccctgggccggggtgggtgtgggtgtggagggagggcccgcgtgggtggccctggtcagcgtcaggggagctccctccaatcagtttcccaccgagctgctgtctgcaggggccggaccccc

SEQ ID NO: 18273 - DNA, 972 bp, Homo sapiens
attaacccatttattataggccagtgatgtctcaaagagtagaggagcgtctactggtctttcaactccttcagtcttctgatggcggactttaccgtgacagcggaagtggtattgtacgtccaggcaccgccagccactgtcttcatgcaggaaccacagtgccagatccccacagctcgtctcttcatcttggttttgccacagaaagagcaagtgtacttggcgtgctggctgatttcaattttcttcaccattttccggagggaggccccatagcgggtcccgtatttaccgacgatcccgactttctgggtacgttgggccatgtcgccgcccacgcgtccggagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggactgcgggctgcagctgagcggggaggagggacgccgttgctatcccctggcgggccacctactgtgtcgtcgttgccacctgcggcgcctccaacctgggcctcttccctcacccactgtgcacgtcactgagctctgagcaggggaaaacccgtccctgggccggggtgggtgtgggtgtggagggagggcccgcgtgggtggccctggtcagcgtcaggggagctccctccaatcagtttcccaccgagctgctgtctgcaggggccggaccccc

SEQ ID NO: 18274 - DNA, 419 bp, Homo sapiens
aagaggccagtacaggaaggcatggcagaagctgttccctgtctgccccgaggtgtgcacacagggagagagggcctgatacttgggctacgtcagtgggttcctgtgggtgcccctgtgcttgtgcccttggcctctggtcactcagctgatcacttctggtttcctttatttctctagggtttttgcaccaaaatgcgcctcctgtgcccgtcctatcctccctgcacaggtaggagccactcacccagagatgatcaggtgcctggcccagccggctgctgtcctgtctagcctgggtctagcccaggtcttgggcgacagtgggagggatgagcaggtgcttctccgcagatctttcagggctgagggatgtgtgttgtgcttgtgtacgtggggtacagctgtcccctggcaca

SEQ ID NO: 18275 - DNA, 327 bp, Homo sapiens
tgggattataggcatgaaccactgcacccagtccaagaatttaattctttgaaaatatttacacttttttgctcaaaattctcctatggcaaaaatacagagttctgccctgagggcctttgcacctctggttccttcagcctagcatggactttctttttttttcagagacagactctcattctgtcacccaggctggagtgcagtggtgtagtcacagctcattgcagccttgaactcctagactcaagtgatcctccttcctcaccctcccaaattgctgggattacacacatgaaccaccattcctgaccttgtactttgttt

SEQ ID NO: 18276 - DNA, 278 bp, Homo sapiens
aaaaatacaaacagggttgagaatcactaatttactagccccagatgagtcaatcactagttaaacgaaacctgcagaacttttagtccattgtttctaaatctttttttgaccagagcccctctttttagttaacattgtgaaattctgaaggaacttaaaagctgacctacaatatactgcttttgtacacaatagaataatagcagtgacaattttattagaaggtttattgtcttgcatttcaaaaacagcctattaaataagtttgtttttaa

SEQ ID NO: 18277 - DNA, 569 bp, Homo sapiens
atgagaaaacagcagaacgccagctttgcaggtacctccacagcactgccgggctgggaacagggccagtgcttgcaccagcgctggagggggccacagcagagtaaagacagagtctgccatgcaggagtgcttcgcaggtcaggcactgctctgagtgctttgtgttaacctgccccccgccccctaacttgggaaaggtgttaaagaaggagagaacgccctcaatggtgtgtcctttgcatacacacctttgcatgcatctgatgtgcccaggctgtgttttattgttctagcaatttattgttacaaaacagattgctgccatcaatttgtctcaggtccttctagcacatctgacagggactagtgtctagagccatgaggacagagaccagaagggacaagaaggagtgggcagagggaatggaaggtagagttaggcccagagagccccaggctgctgcccagacctccacgcctgtgccggatgtggtgttggcatccatagcagtctcgcaaagttgttctcattttccaaataaggaaactgaggcccagggagaggt

SEQ ID NO: 18278 - DNA, 388 bp, Homo sapiens
ggcgacctggaggtacagataccaaccaggaggcccgaccaaaagcagatcaaataggagtgacagagttcagagctgcctgggacaaagttttaaattttattttcactgcaacccataggaagataaacattttatatcatgacccagcacacacacacactcaaagcaaaacttatcacaaaacactatttctttattgtggatgaactcacatgtttttcattccattaaaaaaaaatgctggttgctgcccactaagttgacttcatagtgggccataacccacagttttcaaacttattagggagctcatttagggaaataaaacagcaggattatatccttggtttgatgtgggggttggggagcaagaatcctgacatgg

SEQ ID NO: 18279 - DNA, 465 bp, Homo sapiens
ccgctgtcttttggtgggaacttctcagccagggcgttagtgggcatgataactcaagctcaggtcttgagcacacccactacggactcttgcaagagggagagttgaggaaaatggttctaaaacctcagtaattagaagagacagcctttggccgggtgtggtggctcacgcctgttatcccagcactttgggaggcctaggcgggcggatcacgaggtcaagagatcaagaccatcctggccaacatggtgaaaccccatctctactaaaaatgcaaaaattagctgggtgcgatagcagatgcctgtaatcccagctactcaggaggctgaggcaggagaatcgcttgaacccgggaggcggagcttgcagtgagcagggatccccgggaggcggagcttgcagtgagcagggatcgcgccactgccctccagcctgggcaacagagcgagactccatctc

SEQ ID NO: 18280 - DNA, 2471 bp, Homo sapiens
acttaactagaattctagttaagatggtgatcccatggcttatttgcaaacaggaaggataaagagatcagcgttttagtcatggagctcatctttgcccattcctactcatttgctttttcataggagttttttgttgttaaacagtttctctcaagccacatgcattctatgctggctgaaaattaatagtgatgtagatgttcatccgacaagcttttccccatgtgattggttttagccagagtttatcacaggtacaaaattaggcggtatgactgtgcatgttctctagctgatgttgaaacttgtactgtcttgatcatttaaaactatgtttttgtaaatatcaggtttagtccgctttcgggaatatctgcatgctatggaaagagagaaaaaaaggatagataatgaggaatttggtttaaaagtgtgataaaaatccttggcattctttgttctgatattaattgtatttaaataagtcaacccaatgtaactcattccagatcttagtccagctgccctgttcagcctgatgccttttaaaggtttaaaggtgttaatgttttccttttcaacatggcaaacattttttaaaacctttttggcacaatggtgccactgtcctcatagtgttatttctttggtcatgaattttcaggcccttccagtaagaggagaaaggcacttaactggttaacagccccattattatacattgctctaaggaaaaaaaaaaaaaaaaaactttgaatatatcaagaatgggctattccagaggcttctcctcaggagaaactatgcactaggttcccaccaaatacaatgtgacctttttttcccctttctctgtacacaccccagatatgtgccaagcaaatgagaatgagggccgttgacaattaaagcataaagaagctagtcaccagattgagatggacatgctgctaactgctgacagcttgacctgagcagtcctaacttgtatctggtctgttagcattgggttagattgactaacagagtaaataaaattcacctgtcataagacacgctacatctgctatcatcaagaaacaaatcatccagaagaaactttttttcatcctgtggtcacacccttttcttaagagcttcttttttaaaattatgacaaacgaatttcattctttaaaatcacttatcttctcccaaacttgaagtatttaaattaggtggttttgcttttccctctcattgtttattttttggggatggatctaaatgagtaagatgagcaataaaagataccagaaagactggagggatcacagtgttttcatcagaactaagtagagggtcggttcctgccctggttttggggtagctagaaaaggaaatcatgaatgcactggaaatgttggctcgagagaaaagactggcatagctctgcctcgcagtgggtgagagcgtattgatcgtagggacctgcagagttcctatgaccaggtgagtcggctctgaggaaggggttaggaaagcaagtacagctgcatgaaatagctgaagttcctttggggtcaggaagagccgacaattgtggggttttggttgcttttgctttgtttttgagtgggaagtgttgctggaatcccctgagaaccgaaagatgccaggggtcagcaaggctatagaaaaggccagtggtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaaatccagctgtacaactgaccagtgagttatctgtcatcactgttgcccacatacccgtccttccttgtgtagtttcatcatcctcatccttcccacatcttgcgcaaaatgattttctgtgctcattcggcaataactatgttattcggcatactgtctttttggcatttgttgaaaaatccaaatgcttttaatccaaaagattaatccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcagg

SEQ ID NO: 18281 - DNA, 456 bp, Homo sapiens
gcttctagaaatttagaatatgaaacacttcatagaagagttggaaattcagaatattaaattcttagagggttggaagataaagttgagaaaactcccacggaggaggacaaaaagagttgtaaagtgggagaaaataagaaaactagaggatcacacttgcatgcacgttcaacatatgaaaagtaagaatttgctgggcgcagtggctcacgcctgtaatcccagcactttgggtggtcgaggtgggcggatcacctgaggtcaggaattcaagaacagcctggccaacatggtaaaaccctgtctctgctaaaaatacagaaattagcagggcatgttggtatgcacccgtaatcccagcaaatcgcttgaacctgggaggtggaggttgcagtgagccgaggtggcgctactgtgctccagcctgtgcaacagagcgagacactgtctcaa

SEQ ID NO: 18282 - DNA, 1852 bp, Homo sapiens
aagacgatcctggctaacatggtgaaaccccgtctctactaaaaatacagaaaataagccgggcgtggtggcgggcacctgtagttccagctactcaggaggctgaggcaggagaatggcgtgaacctgggaggcagaggttgtgatgagccgagaccatgccactgcactccagcctgggcaacagagcgagactccatctcaaaaaatagataaataaaataaatttcttccatgtctttttatagcttgacagctcatttctttttagcacagaataacatcccttcattgcacacactgtgtaaagaatgactcctgcttatacacaggacagcttactcaggacagcaacatgatctggtcactgtctaaacaacttgtgcaagataaggtgacttaaatgctatctgagagcagtggtgctgtcacactataggtgacacagctcaggtcccataatctgccttgaaacatttcttcctacactcctcgtatttgctgtgatttataatccgtgctgccctgggtggccaatggtgcttaatgctgtgaacatggcatcttagcccgcacacacaggttcagattctggctttcagatgtgctttctctgtgagttagggatagatatgtaaacctcttcagccctttgttttggtatgaaaaggtgcgataatttacctcaagaggatttacatcaattagtgctgttagagaccttagtaacttgcatagcatttagtatgctttgaaaagttacctttatgaataagatatgtcaagtgtctgtcatgtttcttatgagattgacctttgccttcattatatcttacatattttcttttttgtaattttttttttcatatcaacatttctctgactctacataataaaatgttaaagcacacagctttcattatatgtattttttggccatagaactggaaaactagatgacatttcctagtcagggagtttctctatatactgctgtcatataactgcaggcatgaaattatttcagactcccctcctaattcttcatctttatagtaatgtgcatttacctgaagctgatatttctttctgtagttcataagcagtaattctttagaatttcactgacaattttgtgtaattgtggttgttcattaacttgcctgttagattttcacaggttactaaagtgttttatttatttttgtaatgatttacagatgatggtttttcagtatatattatgcaatagaaccaccatgcacaaattgttaatgctgcaaaatgcacattctacatgggtgtaagtagttttataacaagtactcacatttgcaatttgtaaatattcaaaattttattaaattcttccgaattttttctttcagtgttttgtttgcaattatgaattgtcatttttaaatattttttattagataagcttgagctgtgccttaccttttgtgtgtaataattatgtactaaataatgcattactatttgtttatcttcatatatgagactaccatatagctatgccaatttacgtgttccttggagtggtggtggaaaaatacctcttctttcagagtttatgtggatttacatagtatgagtgttttagctatagggtgttttaaactgtgcttaaaataatttgttacatgttttgttactgtgttactttattgaggacagctagtccctttgtgttgttaaacgtttaaagacagttgagaagcttcataactctgttcattgtaaatcttagctttcttgtaatatgtattttaataaaatatttaccttgcaactctaaaaagtcgacgcggccgcgaatttagtagtagta

SEQ ID NO: 18283 - DNA, 1558 bp, Homo sapiens
aagacgatcctggctaacatggtgaaaccccgtctctactaaaaatacagaaaataagccgggcgtggtggcgggcacctgtagttccagctactcaggaggctgaggcaggagaatggcgtgaacctgggaggcagaggttgtgatgagccgagaccatgccactgcactccagcctgggcaacagagcgagactccatctcaaaaaatagataaataaaataaatttcttccatgtctttttatagcttgacagctcatttctttttagcacagaataacatcccttcattgcacacactgtgtaaagaatgactccttgtgagttagggatagatatgtaaacctcttcagccctttgttttggtatgaaaaggtgcgataatttacctcaagaggatttacatcaattagtgctgttagagaccttagtaacttgcatagcatttagtatgctttgaaaagttacctttatgaataagatatgtcaagtgtctgtcatgtttcttatgagattgacctttgccttcattatatcttacatattttcttttttgtaattttttttttcatatcaacatttctctgactctacataataaaatgttaaagcacacagctttcattatatgtattttttggccatagaactggaaaactagatgacatttcctagtcagggagtttctctatatactgctgtcatataactgcaggcatgaaattatttcagactcccctcctaattcttcatctttatagtaatgtgcatttacctgaagctgatatttctttctgtagttcataagcagtaattctttagaatttcactgacaattttgtgtaattgtggttgttcattaacttgcctgttagattttcacaggttactaaagtgttttatttatttttgtaatgatttacagatgatggtttttcagtatatattatgcaatagaaccaccatgcacaaattgttaatgctgcaaaatgcacattctacatgggtgtaagtagttttataacaagtactcacatttgcaatttgtaaatattcaaaattttattaaattcttccgaattttttctttcagtgttttgtttgcaattatgaattgtcatttttaaatattttttattagataagcttgagctgtgccttaccttttgtgtgtaataattatgtactaaataatgcattactatttgtttatcttcatatatgagactaccatatagctatgccaatttacgtgttccttggagtggtggtggaaaaatacctcttctttcagagtttatgtggatttacatagtatgagtgttttagctatagggtgttttaaactgtgcttaaaataatttgttacatgttttgttactgtgttactttattgaggacagctagtccctttgtgttgttaaacgtttaaagacagttgagaagcttcataactctgttcattgtaaatcttagctttcttgtaatatgtattttaataaaatatttaccttgcaactctaaaaagtcgacgcggccgcgaatttagtagtagta

SEQ ID NO: 18284 - DNA, 753 bp, Homo sapiens
atcaattagtgctgttagagaccttagtaacttgcatagcatttagtatgctttgaaaagttacctttatgaataagatatgtcaagtgtctgtcatgtttcttatgagattgacctttgccttcattatatcttacatattttcttttttgtaattttttttttcatatcaacatttctctgactctacataataaaatgttaaagcacacagctttcattatatgtattttttggccatagaactggaaaactagatgacatttcctagtcagggagtttctctatatactgctgtcatataactgcaggcatgaaattatttcagactcccctcctaattcttcatctttatagtaatgtgcatttacctgaagctgatatttcaaaatttagtgattctcaacatattatttttcctattgtgtgtcccttctgttttttctgtagttcataagcagtaattctttagaatttcactgacaattttgtgtaattgtggttgttcattaacttgcctgttagattttcacaggttactaaagtgttttatttatttttgtaatgatttacagatgatggtttttcagtatatattatgcaatagaaccaccatgcacaaattgttaatgctgcaaaatgcacattctacatgggtgtaagtagttttataacaagtactcacatttgcaatttgtaaatattcaaaattttattaaattcttccgaattttttctttcagtgttttgttt

SEQ ID NO: 18285 - DNA, 428 bp, Homo sapiens
aactttctggattagttgtaggttgcaactgtggcctgtagcctgactctacttccccacttctctcctgctacaacacacaccttaggaaggcagtttgattactgatgcagcggtccccagaaagggattgagcttttgcaggaagttcattggatgatgatcgggaaagaggttatagaaaaccattttgaaaatttaggatttctgttgtttgtttgttcgtttgtttgtttgtttgtttgttttgagacagggtctcactctgttgcccaggctggagtgcagtggcgccatcttgactcactgcaacctctacctcccgggttcaagcaattgtcctgcctcggcctcccaaagtgctggcattacaggcatgagcaatcgtgccccgcttcttttcttgatatataagctggtaacaaaca

SEQ ID NO: 18286 - DNA, 439 bp, Homo sapiens
tagcatgttccaggacatgtatctttttttttttaaagggcataggcagaaggagaggaaaagcagttcagagtactaaggggctatgattggaagggtgtcaagaactagctctctcaccctcaaaaggcctccctggcccagcctgtcctgcctaaattctctaatcagagtgcaggtcactggggagtgaagattctcaacctcactcacctctttcacccctccacatctgcccaccccatctccactatttagtgcaaaggctcctgggaacagcgacattctaaactgttaacagctgaagccttccaaaggattctgtcccccagtgacagttggctgaagactgtgaaagagaaagagcggtccttcagggttgggagaccaagagggaagggaaattactagcctcaggaagaagcagactcccagcctg

SEQ ID NO: 18287 - DNA, 369 bp, Homo sapiens
ggtaactgtagtcttgtagtataattcaaagtccagtcatgtgatacctccagatttgttcaaaaacttttgcttaggatagctttggctattcgggctcttttttgattccatattaattttaggatttttttttctaattctgtgaaaaatgatgttggtattttgatggaaattgcattgaatctgtagatttctttaggcagtatggtcattttcacaatattgatccttctaatccatgagcatgggatgcatttccatttgtgtcatctgtgatttcttttagcagtgttttgtagttctccttgtggagatcttttacctcccgcattacatatgttcttaggtattttattttttttcctg

SEQ ID NO: 18288 - DNA, 335 bp, Homo sapiens
tataagctgtggtctgtgggaaaacatatgtgttagatacaaccttgcctagaaacttgcgggtttattccagcctaggaattttccttctcttttcctcccttttcttcatacttaagaacccatgaaactagtgttctaaatagtacttaagccaatttctttgaataattttttttttttacatttttattttaaaaatgagacagaggctgggcgcggtggctcacacctgtaatcccagcactttgggaggctgaggcaggcgcatcacttgaggtcaggagtttgagaccagcctggccaacatggtgaaaacctgtctctactaaaga

SEQ ID NO: 18289 - DNA, 444 bp, Homo sapiens
atattttatggtagtagatgatagactagtatctacatatgtttttatatttgatgcatttatgacattcttaattcttttgatatttttcatgtttttcaaattgttgcaaatctcctccaaattttccaatataatttattgaaaaaaatcagcatataagcggacctgcacggttcatccccatgctgttaggccaggcgtggtggctcacgcctgtaatcacttttggaggcccaggtgagaggagtgcttaaagccaggagttcaagaccattctgggcaacaaagtgacaccccatctctacaaagaagataaattagctgggagctgtggtgcatgccagcttcccaactacacaggaagctagggcaagaggatcattggagcccaggagtttgagaggctgcagtgagctgtaattgtgacactgcactccagcc

SEQ ID NO: 18290 - DNA, 698 bp, Homo sapiens
tgagacgtggaggttgcagtgagccaagattgtgccactgcactccagcctaggcgacagagcgagactctgtctcaaaaaaaaaaaaaaaaagaaaaaaaagaatgccttattagcaaaggactaggtggtatagagaaaaatatttacattgtcgtaataatgtaaataatgacattgggccaggaacagtggcttatgcctataatcccaacactttgggaggccaaggcatgtggatcacctgagatcaggagttcgagaccagcctgaccaacatggtgaaagcccatctgtactaaaaatacaaaaattagctaggcgtggtggcaggcacctgtaatcccagctactcaggaggctgaggcaggagaatcgcttgaacccaggaggcagaggttgcagtgagccaaaaccatgccattgcactccagcctgggccacaagagcaaaattctgtgtcaaaaaaaataaaaataaaaataatgacattggttttcaacttttagaatcagcctacagacaaagcatggaatgatataatttttaaattatagggaaataaaacttggactcagccaggtgcggtggcccacacctgtaatctcagcactttgggaggccgaggcgggtgtatcacgaggtcaggagtttgagaccagcctggccaagatggtgaaacctcatctctactaaaa

SEQ ID NO: 18291 - DNA, 351 bp, Homo sapiens
atctggaaaagccactgttcagtgggttcctgctgctgagttgaaaacttaggggaggcagctgctgctgtgataaacacgagagccaccgtcgccgggtggtgcttagctctaggaactgctggcttcacagagctgaatgctaaatatggcatttgagaaactccagtcagcagcagatgtgaaaagcatgtttcaagtccccatttgtgccctggtattcacagagcagtcagcctgtcctcacataggtacatgtggaggagtggagatcagaactgcacgcaccacagtgcacaaccttcagaaatacgagtgcccatcatttctcttggagcctggcaaacaggt

SEQ ID NO: 18292 - DNA, 271 bp, Homo sapiens
gaggtgtgaatcaggtcatgtgtaaggacaattcataaggcagtggcatgtgggatagattgctggaaactaagaccataaaggcaggccattgcactggcccaggaaagaggcagtgagatcctgtgccacagtggtagccatagagtatggaagagaagccattagaatccatgggctcaggactacgaactggagactggctggtcccacaggctcaaagccacttgcagtttgtaaggggcaactatgaaaacaaacaaacaaatac

SEQ ID NO: 18293 - DNA, 435 bp, Homo sapiens
ctacttacagtgctcttactttatgaaagatgtgacattcagcattttggggaagcagagacatgactccgactcttcaggagctcaacaatgggagaggcatgccccaggttgtctgtgtttgagaggcagggaagtctgtgccaagttctttctgttcatggttactggaattctcacctctagcatctgatttctttctttcctgtgtgagctacctcccatgggcattaaaaatcaagtctctgacaccactccgcatcttcaaagaaaacaaatcatttacagaattttaatcagataaagagaggagaaggctgggcacagtggctcatgcctgtaatgccagcaacttgggaggccaaggcaggaagatcacttgagcctaagagtttgagaccagcctgggcaacttagtaggactcccatctctac

SEQ ID NO: 18294 - DNA, 385 bp, Homo sapiens
aatccatgtttcttggaagacccttcataattgtgaaccttacttacctttctagccatatttcttaccagttctccctaattctctgttgcagctactgggaattgtttataattcctagaatgttaagtgtttttcatatctaagttttgacacgtgccttgaatgcctttcttccttatcttctccctacttatacctggttcctgcaggactcatatcagtcatcatcatcatctccagaagccttctctcactccatgaaggctgtattaaatccttctattaagttcgcccatcatgtctgtagaaccgaatgatagcatttattttacggtattatgattgcctatttacttgactcccctcctaaatagtaagctcc

SEQ ID NO: 18295 - DNA, 1773 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatgctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 18296 - DNA, 451 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatgaatcagtctcagtgtttcctgtttggattgccatgaggacatcaacccagagtgactgtagaccctcttcccagcacctgagagtctttgagacatttgaggttgttgtgtgcagactgggatgggagttgttccagttttcacttgggtgaaaaaaaaggagagctggagactgatcaaccaattactttcatttcatatggcgattagaaaaacagatgaggcaatcataatctctgcaatccaggaactgtgtctgtggcaaatgaataaatggctgaatttca

SEQ ID NO: 18297 - DNA, 586 bp, Homo sapiens
gggatattttgttaatttcatatttcagctatgtcttctcattacactgaagaccttttgccagaacagtgcatgcaagattcattccaaaaagtgatactgagaagatatggaagctgtggacttgaggatttacacttaaggaaggatggggaaaatgtggataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 18298 - DNA, 337 bp, Homo sapiens
cctcccgggttcgtgccattctcctgcctcagcctcccgagcagctgagactacaggcgcccgccaccatgccccactaattttttgtattttttagtagaaacggggtttcaccgtgttagccaggatggtcttgatctcctgacctcgtgatccacccgcctcggcctcccaaatgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtta

SEQ ID NO: 18299 - DNA, 1996 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 18300 - DNA, 2157 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccaggctagattacagccttaccattttgtgtaaaaagaagagcaacatattaataagtttccctagtattatatgaggagtcatgagaattgttgtaaattcaacatctattcattggtggatgtatattttctttttgtgagagaaacacttgtgatttgaagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 18301 - DNA, 1012 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccaggctagattacagccttaccattttgtgtaaaaagaagagcaacatattaataagtttccctagtattatatgaggagtcatgagaattgttgtaaattcaacatctattcattggtggatgtatattttctttttgtgagagaaacacttgtgatttgaagctatgtcttctcattacactgaagaccttttgccagaacagtgcatgcaagattcattccaaaaagtgatactgagaagatatggaagctgtggacttgaggatttacacttaaggaaggatggggaaaatgtggtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtta

SEQ ID NO: 18302 - DNA, 716 bp, Homo sapiens
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtta

SEQ ID NO: 18303 - DNA, 313 bp, Homo sapiens
ctaagagggaggggaataagtcattcagtgtttcttctctttctcacaaaaataatctctttggttggttcctagatgggagttgttccagttttcacttgggtgaaaaaaaaggagagctggagactgatcaaccaattactttcatttcatatggcgattagaaaaacagatgaggcaatcataatctctgcaatccaggaactgtgtctgtggcaaatgaataaatggctgaatttcacaccatggagtcagtacaaaaaagggacgtgtgcaggggatttagggccactttccttatgttgggaactct

SEQ ID NO: 18304 - DNA, 415 bp, Homo sapiens
cattgataagtggcacatgacggtatctcagtcataagagggttgcatgattcctttgaatgtttgatttggaaaagcctagtcttgtctctcaagagcatctcagacccagaacattctctagtagtgcactcagttaaacagggcaagtgcttcactgcatggaaaacactttgaagagacaaaaaagaaatcttatttcttttttgtagcctttctgatatttacaataataccactaactgttttctttatcgatagcaaagaacgatactttttgcaatgtaattagacgttctatagtgctacaaggaaatgccttccaaaaggaggctcatgtataatactcatttacaaaatatataattacgcaaataaattttaaatataatcaataataaagactgttctgtgg

SEQ ID NO: 18305 - DNA, 979 bp, Homo sapiens
aggtgtgcaccaccacacccagctaattttgtatttttagtagaggtgaggtttcaccatgttggccaggctgatctttaactcctgacctcaggtgatccacctgccttggcctctcaaagtgctaggattacaggcatgagccatcatgcctggccaaatttcttaatttcagatataccctatggcacagatattttaaggcaaaacataggtatattatgccatacataagtgtattggatgaagctgacagagaaaagtatataatcattctgagaaaagaagcctcgatatttacatttcggtgaaaagggggagaaaattactgttttgcgaatcaaccaaagtactccatagtcattacagaagcatgtacttacctgtaattttttgtggaattgttcaaagtttattgtttaacacttattgacaatcactattatgctggatactatgggagcaagtttatgcaagctaatcccctgctgtgttaatctagggaaagaatggaacagtgatcaaatttgcaaggttagaaatgctaaagctcttgctttctgtcagaaaactccagctaggtattcaaatttagtcgagatccaatatcagaaagcctttattatttattgaagcatctgctctttctactttttccatttggcttctgtgctctgtggttactattctcaggtaattgggggtatgacttcagtcacttttgaaatattgggaactaaattctctcattggagattcagcacattcaggcattttaataaaactctagtatcttgaattctggaaatttaattagtatacttacactttgaattttttcttgcctgaaccattacacatttttacagaacaaatatttaatccttaagatttcataaccaagggatttaaagattagctttgaaaataggtcagggaaaatatccactttggttaaaagctaatcatgtaaagaagt

SEQ ID NO: 18306 - DNA, 696 bp, Homo sapiens
aataagtagaatggcatctgtctcaacacctagactggattgaaaatccaagcgattgaatataatcattacctaattgccatttcccagggatctatgtaggtatgtcagtttggttctataatgtttgtaagggtcctctcttagacgttggaatactcagttatacctactggctcatggaacaggtgttcttaggaagaaactagaaggttacttctagcctcatgttaattttactgctggatcctaggtttaccatgttcatgctctagaaagaagtaagaggcatgagccatcatgcctggccaaatttcttaatttcagatataccctatggcacagatattttaaggcaaaacataggtatattatgccatacataagtgtattggatgaagctgacagagaaaagtatataatcattctgagaaaagaagcctcgatatttacatttcggtgaaaagggggagaaaattactgttttgcgaatcaaccaaagtactccatagtcattacagaagcatgtacttacctgtaattttttgtggaattgttcaaagtttattgtttaacacttattgacaatcactattatgctggatactatgggagcaagtttatgcaagctaatcccctgctgtgttaatctagggaaagaatggaacagtggacgggatcctctagaacacagac

SEQ ID NO: 18307 - DNA, 309 bp, Homo sapiens
agctacatcagtcttacttttgagagtccttttttaatgtttggtttttctaaatgttctttagtgctagacccactaattgcttccttatggcagctgcttttgatttaagactgatcatgggcacatatagtcccttgttcagggctcagatggacatcacaaaaaaccttatagttatgatcttactgtggaaaatgcccagaaaataatagccataaaaatttgttttctagtaagtgaggctggttttgatattttaaaagtttctgtttatacccaccccctctgcttggtctcttttaatct

SEQ ID NO: 18308 - DNA, 478 bp, Homo sapiens
ataatatttcatgctatggatgcattatagtttatttgactaatatcttgttgaaatgcataccgtttccattttcactattataaggatttgcaaacaattgttctacatacctttttatatagcctgtggtcatatttctaaagcacagattcagagaagtgggaatactggctgggcgtggtggctcacgctggctcactatgacatctgtaatcccagcacttcgggagggtgagatgggcggatcacctgagatcaggagtttgagaccagcctagccaacagagcaaaaccccgtctctactaaaagtataaaaatcagctgggcgtggtggtgtgtacctgtaatcccagctactcaggaggcagaggcaggagaattgcttggacttaggaggtggaggttgcggtgggccgagatcaagccactgcactccagcctgggccacagagcgagactctgtcttgcaaaaaa

SEQ ID NO: 18309 - DNA, 803 bp, Homo sapiens
actattgagaacttcactccactgtcagcatttgatcgtctaaacagaaaatcaacaaacactggatttaaactgcactttagaccaaatggacctaacagacattttcagaatcttttatccaacagctgtagaacacacattcttctcatcagcacatggaacattctaaagggtaaaccatacattaggccacaaaataagtctcaacattttttttttttagacacggtctcgccctgtcatccaggcaggaatgcagtcctacagctcactgcagccttgaactcctgagctcaaattatcccctcttcagcctcccaagtaacaaggactataggtgcacaccacaatgcctagctaattttcaactttttgtagagacaatgcctcactatgttgcccagtctggcctcaaattcctggcctcaaacaatcctcccacttgaggatcctcagattccaaaatactaggattacaggcgtgagccaccaagcctggcctcaacaaatttttaaaaattaaggctgggtgcggtggctcatgcctgtaatcccagcactttgggacaccaaggcaggcggatcacaaggtcaggagttcgagaccaggctaacacagtgaaaccctgtctctactaaaaatacaaaaaattagctgggcgtggtggtgggcgcctgtagtcccagctactcaggaggctgaggcaggagaatggcgtgaacccaggaggtggagcttgcagttagccgagttcacgccactgcactccagcctgggcgataaagcgagactccgtctc

SEQ ID NO: 18310 - DNA, 584 bp, Homo sapiens
gcccccaggaggaatgtgttgtaatctctagcagcaaagaggcccttagatatcgtgcaatataatgaataactgatcccaaagcatctaaatgatttcaagcgtgctactgctctcaagaatttatgacccagacaacagtggctggggtcagggctcgcccctggccaggttaccagggcttgcctctgcaatggagtagagccctttattgttcttttgtctaggaatggagtttcagatcagaagaaatccaaatactcaaaaacctcttgccccaagcataaaggactaattccttggcgtagagcaggaactcaccaaagactataaggtctgacaatgcacgacaggggaaagagagagaaagatgggaatgtccacagtctcattacttcgacaaacacccgcaaggccccacccggtcaaaggtaaggcctggagcagccgtgcccacacaatgagatgactggactggttcatctgtttattggcaagctcaggacagggtatgagcagtggtggagaccggcaaatgtcaaatgaatgaacataaaaacaaggaagatttgaatctctgcagg

SEQ ID NO: 18311 - DNA, 468 bp, Homo sapiens
attttataaagaaatgtctttgttaagatgctgtttattttagaaagtgaacctgagaatcttcttgttataacaaagtgtcttattaagttaactcaaaaactggttgctttaggagattatgggactcagtatcataggggattgagtcagaagacacaagttgtggagttggacctgaggccctagcatagagttctttaggacagtaactccatgaagagaaaaatctccacttatatgaggaagtttgtctctacctgggctcttctctgaaaaaacccggattttttttttttttgagatggatcctcattctgtcacaggctggagtgcagtggtgcgatctctgctcgctgcaacctctacctcctgggttcaagcaattctcctgcctcagcctcccaagtagctgggattacaagtgcgcgccactatgcccagctaatttttgtatttttagtagag

SEQ ID NO: 18312 - DNA, 423 bp, Homo sapiens
tgggacgtttgattccttctccaactttcctgaccacaagggacactgggcccgaccacagggcacattttcacagtgacccatggctgtttccctacacttctgtgatgtccagaatgccacttttattttgttagaattttaaccacattgctattttgttaatacttttttttttgaacgtattcctttaaatatatctggatacttttttttttctttttttttgaggtggactcttgctctgtcgtccaggctggagtgcagtggtgcaatctcggctcactgcaacctccgcctcccaggttcaagcgattctgcttcagcttctgaagtagctggattacaggcatgcaccaccacacctggctaattttttggatgcaatttttttaaattattattttaattttttgagacgga

SEQ ID NO: 18313 - DNA, 244 bp, Homo sapiens
gctcttgctctagtctccaccagggtgacaccagccagtcgtctggccattcaggcacttgtttgtcctgctcttgctaattgggttggcatttggcttgtcaccaggtatttgggatgctcgcagggaaagtgtggagaaatacaaaccatcaccttaataattggtatgatatttcaggatctctgaatttcttcctttgtgtgatatttctggagagaaaaatccactaataaaccttttt

SEQ ID NO: 18314 - DNA, 381 bp, Homo sapiens
agctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaag

SEQ ID NO: 18315 - DNA, 335 bp, Homo sapiens
caaattcaaaagatcccactcattatcaatatgtggtccttctacagttttgcatagtataacatattcttaaaatgggatacatagtgactttgtagcatcaactatttaaattttctagctcctgagtccttttcttgctgtgaaatgtgttcattttattgtgtgatgatattaacatatatcaagaatataagtgaaatattaaatcttgtcatgttcagggttttagggttcttaaaaatgtgtaaaggtgtttttacactgtgtaaaaaaaaactttatatgtttgtgagattttgagttacctaattttataaactaaattactttgt

SEQ ID NO: 18316 - DNA, 727 bp, Homo sapiens
aaaaaacaatgtaaaccatattaaatgttttgaacttgatcctaagggtaataatcagccattatatgtaacaggcatagcagggacataataatatttcatatcctccttagaatgatcactgtttgcgtgtggaaaatagattggtgtctcagaccagtctgtttgtcacagtggtctaggtaggagaagacaatggcaaaggggatgagaagtggattgatttgagagatatttaagcaatagaatcaatagaacttgattgatcagatacatgagatatgaaaggaggaaggaatggtcagttttctggctcaaatagctgggtagatggagctcctcccaaaacagtttatcaaattatttattatatattgtgtttgatatatttaatcacattatagaaatgaactcaccactaattcagcctcatacccagccaggcacggtggctcatgcctgtaatcccagcacttcgggaggctgaggacggtggatcacttgaggtcaggaattcgagaccagcttggccaacatggtgaaacactgtctctgctaaaattacaaaaattagctgggtgtcatggcaggcatttgtaatcccagctattcgggaggctgagggaggagaatcacttgaacccgggaggcggaggttgcagtaagccaagattgcgctgctgtactccagcctgggcaacagaggcagactccatttcaaagaaaa

SEQ ID NO: 18317 - DNA, 480 bp, Homo sapiens
aaaacattttaaaaggcatcagacacctggaggccagaaggaagtgacataaaacttttcaagtgtcacttttcaagaaaataactattaacttagaatcttttatccagtgaaaatattcttcagtaatgaagggaaaattgagacattctcaaagaaaggaagaatgagagaatttattgcctgcagatctacccttaaataatggctaaaggaagttcttgcattaatttttaaataaactgtgagatttaggtcgaagtttttctttttttgctttggatgtccaaatgctccagcattgtttctcgaaaagactatccattgaattgcttttgcacctaaaaattggtgggtatatttgtgtgggtctatttctgtgttctctcttctttcccattactctatgtaattttccctcccccagtactacatggtcttgattactttatgtaataagcatgaattaatatcaattat

SEQ ID NO: 18318 - DNA, 502 bp, Homo sapiens
caaacttgctttgtttaggaatcagcacattttaaagcataatttgtatattatagttaaaaggttttaaatttttaaccgtcaaagctagaaagtattgaacacagaattggagacacttatttaagaatggagaaaataatgttacgataaaacatttgaagttactgatgttttgcatatttaagagtgtctggtttagaaaattacctgagcagggtgtggtggcttacacccataatcttagctacttgggaggttgaggcagcaggatctctcgaggccaagagttcaggaccagcctgggcaacatagtaagactcgtccctaagaaataaaaaaaaattagccaggtgtggtggtgcacacctgtagtcagtcccagctcctcaggaggctgaggtaggaggatcacttgaacccaggagtttgaggctttagtaagctatgattgcaccactgcactctagcctgggttacagagtgagaccttgtctcttag

SEQ ID NO: 18319 - DNA, 567 bp, Homo sapiens
ctttcctgattaacctgcttctcacctatcctctgtccttcggaatctttttctttgtatggctgtctcaactcagcctaactttctttcaaagccctgctgagaagaactttaaaacattttgtatgccaggcacagttgtgcacgcctgtaatcccagcactttgggagactgaggcaggtggattgtttaagcccaggagttccagaccagcctgggcaacacggcaagaccccatctctacaactacaaaaaaatgtatctgggcctagtggcacgtgcctgtgcttccagctgcttgggaggctgaggcaggagaatcgcttgaacccgggaggcagaggttgtagtgagctgagatcacgccactgcactccagcctggcgacagagcgagaccctgtctcaaaaaaaaaaaaaaaactgacgcaagatctggtgaagcattttatcaaagaaaaatacaaaaaaaattattatcttttatttgtaaaaaaaaaaatacatgcctgtttcactataacaaggatggcgaccatggaaccaaagtgataaagaacctgaatg

SEQ ID NO: 18320 - DNA, 298 bp, Homo sapiens
ataaaaggcatatataggaatgaatatttttttcattgctttgtttatactaacaaaaaaataaaaatcccaaatttctataataaacaggataattgataaactgtggtatatttaaactctgaaaaaaaatttttttttaagatacagtctcgctctgtcgcgcagattggggtgccagtgacatggtcccagcacactgtaaccactgcctcccaggttcaagtgattcttgtgcctcagcctcctaagtagctgggattacaggcatgcgccagtacgcctggctaaatttttt

SEQ ID NO: 18321 - DNA, 350 bp, Homo sapiens
gacacaatcttaccttccagttccaccagaaaaacctagggggatgtttaaaatgcagtagttgagcattaaattgtgaggaggccctgctgaaggctaagacctgcactgcaccagttccatgcccatgaagccagccctgcatgtactcaagtctcagttgtttcagaaatggcctgagttacagtcacgcgaaagaagaggagagataatgttgatgaggatatttctacttgagccacagggaatatgttctgcatagtaaagagagttctgtgttgcttgacaggcaaagtcaagaagttcttcactagaacttactcaaaaacttgggcagtcatttgagaaaa

SEQ ID NO: 18322 - DNA, 1164 bp, Homo sapiens
ccatgatgaggtcacagttcccctgcactatctcttgatgtgtgatgtcccaccgaggcccacaggtgggctgtgtccctcgatgtctggaacatacattgaggtcacagggttctgccttcccggcgcccccttctagatgttgccacgtggtcaatggataagcagacagcacccgaggagctgctgaaacacagcgtctatcccgagctttctcttccttagtgctacttgctcaacactgcctgtgcctcatgtctcgctctctctcccctgggtgggagcacagggagaccactctgtgaagctctgggttcccgacagcctcattagaaatgaagccaaaaagcacaggcacagatcaggagaacagggttgtgacccctggaaatgacacgtctgtccctggaggtggcgtccttccccatgcttcttcccaagggcggaggaaacccagctccagggtgacccacagccacttggatctccgggtatcagaagactggcgccaggcccatagccgggttttcacaccggaggaggtgggaggggttttcattttgttttgttttgttttgttttaataaagtcatgcttgattaaataaaatgagagaaaagtaaatttaaggaattgtgagggagaagaaagagcagattgttgtgaacagttggtgggatatctatgcagatagacagtgcacaaaaattataggacacagctactgattttttctctgttctccttttaaaggaccagtgcgtagatatctgggtcacagccctggggagaaatacaaaaacattcacgcatgatatggagagaaaataaagaatagaaatatccatgactggctgaaaacacatgaagaacaaacacagatgcacgatttatgtgttctggaagcaaaaccattcctgcctaatgcagccatttattcagctttattattctagcaagtaaaaaacacaaaactgcgctttgtgaaatatccggagggaagcagaggaggaaagtgctgcctgtgatgtcctggggtcagcactggccacgttatctgcagagacgactggggtcatggtgtgaagttccatcgtggaggaagctgacaggcttgttagtgcgcccctcatagtcagcggtcaccacaccctgtcacccacg

SEQ ID NO: 18323 - DNA, 545 bp, Homo sapiens
  misc_feature (22)..(22): n is a, c, g, or t
gagctcggtacccctggtacgngagtggaaagagcagattgttgtgaacagttggtgggatatctatgcagatagacagtgcacaaaaattataggacacagctactgattttttctctgttctccttttaaaggaccagtgcgtagatatctgggtcacagccctggggagaaatacaaaaacattcacgcatgatatggagagaaaataaagaatagaaatatccatgactggctgaaaacacatgaagaacaaacacagatgcacgatttatgtgttctggaagcaaaaccattcctgcctaatgcagccatttattcagctttattattctagcaagtaaaaaacacaaaactgcgctttgtgaaatatccggagggaagcagaggaggaaagtgctgcctgtgatgtcctggggtcagcactggccacgttatctgcagagacgactggggtcatggtgtgaagttccatcgtggaggaagctgacaggcttgttagtgcgcccctcatagtcagcggtcaccacaccctgtcacccacg

SEQ ID NO: 18324 - DNA, 207 bp, Homo sapiens
catataccattacccaatttccctccatgggaaaataacattttgcataactttaggacagtatcaaaatcaggaaattagcattgatgcaatctgcagtgcttattcagattgaaccagttttacatgcactcatgtgtgtgtgtgtgcgtgtgtgttcgttctatgcagtttttatcacaagtggagatttgtgtgaccaccact

SEQ ID NO: 18325 - DNA, 377 bp, Homo sapiens
ctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttc

SEQ ID NO: 18326 - DNA, 239 bp, Homo sapiens
gatgagaagatcgcatgaggccaggagttcaacagcctggacaacatagcaagatcccacgtctacaaaaaatttcaaaaacaaaattggccaggtacggggtggtgtgtgcctacagtcctaactactcaggaggctgaggcaggaggactgcttgaatccaggaggttgaggctggagtgatccatgattatgacactgcactccagcctaggcaacagggtgagatcctttctcaa

SEQ ID NO: 18327 - DNA, 428 bp, Homo sapiens
gggttattagctgaatactaaaatcaatcgttcaatgtcccaggattttatcaattagatttaactgtaatttaagacagtcattagcttcctaaattcttaaactttcagagcttataaaagcaacacagcctggctgtgtaatttcaatcaccaagtagagtcaaaacgtgtttcaagagatcactaaaatgcctgctggaactgaggaagggaaaaaacaagataaaaacaaacactagcaaaaccgataccctagtcacctaataagcttttagacaacagatctccctccagattcttgcaagatttcttctttgacctgactccctttaggatataataatttatatgggtgcccctactatcaggggtttaaggtgaggtcatcgcttttggttctctatatgtcaaaagcactcagtacc

SEQ ID NO: 18328 - DNA, 398 bp, Homo sapiens
acagggccttggtcagcaaagaacaaacccgggtggtcttagtccaaacatacccctgaataaccaagtggcctccaggtttgacagctcataaccttttaaaaagtggtaaaatacaatttcgcacaaagtctggctgcagttggcaaaccaggtgcactgcatgaaatgttcatgtgaaacccaagcagtagggcaggcagctggaacaatcgctgtctaagcacagttaacgcccacacagccccagggaagggcagctctgcacaaagggcatgtctgaaggaaaacagcaccaacatgtttgtttatggcagagaaaaaccaagctgcttctttcttcctcttccccttcccctcaatctgtattaataaagagactttaatataataaagaa

SEQ ID NO: 18329 - DNA, 446 bp, Homo sapiens
gcaagtttcctcacctcattgcacctcagcgttttcatctgtcagatggggataagaattttgctcacctcacattttacttgtgataattagattatgtgacacatataaaactcttggtgcgggcccagtatttacatgggttcttcctcacaaatgaatgttttttattcttgcacttaattgtgttttcttttctgcaggaattctgagagaaatctaggcacctgagttagtccttggcaccgtttaggcagtaaccaaatatttcctgatgaatgaataaatgaaactgtaaagaaatgaatgctttcattcatatattgctttgtatactaattaattactttcaagtataaggatctctttcataggtctaaaacttttagcagacctctggaccaattgcaaatcctagctgttcttagaatatgtttcaaatgaga

SEQ ID NO: 18330 - DNA, 318 bp, Homo sapiens
ctgaacagggccctaaggagcgagttgacctcagttctagctggtgaacaggcccccggtgagcccacctgcggtgagggtgggggtcgctggccagcgcaggggtcagcgtgcttccctgacaggcgctctcaggaccaccattttgagcctgtggaaggacctgccttggagctcctggtgggggcaggacgttttcacttcgtgacttagttgcgtttctgccaatcagaacccaggtctccatccctagaccacaggacaagccagcttctctctgggcccaagggagagtcacagggatgccagattgcgggg

SEQ ID NO: 18331 - DNA, 2445 bp, Homo sapiens
gccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggaaaaaaagaccacaaagaaacaatacaacaaaacagacaccacacacaaaaagggggggcggcctaaagagttccc

SEQ ID NO: 18332 - DNA, 2412 bp, Homo sapiens
gccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccaggtcaggctcgggggtgcagccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggaaaaaaagaccacaaagaaacaatacaacaaaacagacaccacacacaaaaagggggggcggcctaaagagttccc

SEQ ID NO: 18333 - DNA, 488 bp, Homo sapiens
cccgtctctattaaaaatacaaaattagctgggcttggtggcgcatgcctgtagtcccagctactggagaggctgaggcaggagaatagcttgaatccaggaggcggaggttgcggtgagccgagatcgcaccactgcactccagcctgggaaacaagagtgaaactgtctcaaaaaaataataaagaaaaaaaaatgacatattacagttgcaactttgagaacctgaggttccgtggaatattccacagatcgccagaccttaggcccccagaggtctcctcgaaagatccctgattggaagaaggggctccaaggggcgggactgggggcctgggccaccatctctgccagatctatggggcaggggctcagcctggggaggtgccctcctgctggggattttggaccccagcaggggacctgcatctaactgcagcccacctatccccttctagaccaagagtgcagatttccataagcgggag

SEQ ID NO: 18334 - DNA, 424 bp, Homo sapiens
ttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccagtaagtaccctgattctttttcagattcatctgacacaattgataaaaataaaattcccaaggg

SEQ ID NO: 18335 - DNA, 276 bp, Homo sapiens
gtaaaattaatgaaaaatctattaaatgttactgtaaataacatgctttcaatgaaaataactgtatttccaaaacaaaaaatagtgagaacagtgacattgctttgcatgtgtgaaaaatctctttaatataaagcttgatagaagttagtagaattctcatatctgtttctgtattcaatctgttgaaatatgttgttttggttaaaatatatgaagaaaatttgccttcacagaggtatgaaactaaaggaaaaatatttctatagactttta

SEQ ID NO: 18336 - DNA, 701 bp, Homo sapiens
gccaaggacaggaaatgcactgatgggtaatgtcctccctatagtagatgaaagtctctactgccttcccttaatgcttgttccttggctctgctgacaagttgggagccagggtatgaacttggtgggtggcgacacatctgctgacctcgggtctgctgggaagaatacagggcaggacctatgtttggtgtcagaatcatctggaggtaggttggagccactccccttttttctccattctatccccattctctgaaaaccttcgctggctatagggataatcaggctgacaggaaaacttttaaattcatttatttgaattttagagaaaactagaagacagaaaaccacaactgtgggattgaagtcaacagaaaaggcctgacaagacagtattagaatgagtggcctgcctggctgggcacaatggctcacacctataatcccagcactttgggaggctgaggtgggcagattacctgagtttgggagtttgagaccagcttgaccaacatgaagaaaccccgtctctactaaaaatgcaaaaattagccaggcgtggtggtgcatacctgtaatcccagctacttggaaggctgaggcaggagaatcacttgaacccaggaggcagaggtagcagtgagccgagattatgcctttgcaccccagcctgggcaacaagagcaaaactcatctca

SEQ ID NO: 18337 - DNA, 213 bp, Homo sapiens
tttaaatatttctattctaaagttccaaaataatcagtggaatttgagattagagcaagaaagatagctctatctaattgtttttgtagcagctgaaactaaaataatttgagtgctgaaaccttagttatgctttgttagagatcatttgaaaatattccacacttaagcattcattgtttgaagaactagacagtttgtactcaggtactt

SEQ ID NO: 18338 - DNA, 578 bp, Homo sapiens
cattccttggtttaatggtttggatggatggtggtggtctttgttgacgctagatatacaggagtagaaaagccactaaaaaaacccacacacatttctgttttatgtaggcatcttgtataggacagactaacaaaaatgaaactgtttcttaaatttaattgaaatacaatcagcaattttctcattataattttacttaaccctgtacagttcagtctacaaaaataagtattggtagaatagccaggtgcagtggtgtgtgcctgtattcccaagctgctctggaggctgaggcaggtggatcacttgaacccgggagttcgagtgcagccagagcagcatagtgagacgctgtctctaaatattaaaaaaaaaaaaagtttttttgtactaaagtgaatgtctgatatctgcacaccccacagaatgtacagtggaattctaatgccttatctctgaacttactatatataacattgatataaccttttctattgtttttgacgcctattttattcagttagcattatttcccttggcatccttatagccaggcaatcccttatgatgaaatt

SEQ ID NO: 18339 - DNA, 431 bp, Homo sapiens
tcttaatttgcatcatttagatcataacccatgattagtttaaagcgatttggattataaatgctatcccatactttcaacatttgaaaatatcattcagggttggttaaaaaaatatgattgcacctccctttgggcctcacagtaaggcattcgttgccttggtaatttgactgtgtctggtgtagggtctgtcactcagctttgccaactcagaagtctgatgttgtcagcactcagagggcagatccgtctctctcgggtgaactcacattaactacattcatgaggctaataaaaccagaatgccaaattattcgcttaccattagaaatacaatcacacagatggaatgcttgtcttagcaagactcaaacattctttttcaaaatgaagagccagattacacttagaaggggcccagtgagcct

SEQ ID NO: 18340 - DNA, 395 bp, Homo sapiens
ttagagacagggtcttactctgttgcccatgctggagtgcagtgactcaatcacagctccctgcaacctttaactcctgggctcaagtgatcctcccaccacagcttcccgagtagctgggacctcaggcatgcgctactgtgcctaatttttttttttcagagacagtgtctcacagagttgcccaggctggtccgtgaacctgcccgggcagaggccttgacaggttttttgggttgtttggttccaacggtttgcctttgtgggggctcctgctgtgccggagacttctgacagctcctctttccggggtggggggcttcgggtggggcccggggggctttgctggagcttttagggggaggatctttggattcagaatgctcctgactcgt

SEQ ID NO: 18341 - DNA, 326 bp, Homo sapiens
gaaactcatttatcatggttctgaaggctgcaaagtccaagatcacggcaccagctgattctcttcctagggagagctctcttcctggcttgcaggtggcccttttcttgctgtgtcctcatgtggcccttctgtggtgtgcacacacacacagagagagaagctcttctttttcttataagaacacccctcccatcatgaaggcccagccctcatggcctcatctaaccctcatcacctcccaaaggcccagtctccaaataccagcacattggtggggtgaggaattagagctacaacatgtgaattttggagggagacaaaca

SEQ ID NO: 18342 - DNA, 495 bp, Homo sapiens
gttctttaagttttgacagccatattcagtcgtgtgtccaccatcacagttgtattagtccggtctcatactgctataaagaaattcccgagactgggtaattaataaaaaaagtggtttaattgtctcacagttcctcatggctggggaggccttaggaaatgatatggtggaaggggaagcaggcaccttcttcacaaggtggcaggagagagaggaatggaggaggagcttctgagcacttacaaaccatcagatctcatgggaactcactatcacgagaacagcatgggggaaccatccccatcattcaatcacctcccaccatgtcctctctcaacatgtggggattatggggtttacaatttgagatgaggtttgggtggggacacagaagcaaaccatatgggcaatcaagatgtgaagcattttcataaccctacatgttctctcatacctctttataatcaattcctccctgtcttcaccccctgt

SEQ ID NO: 18343 - DNA, 436 bp, Homo sapiens
attcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgc

SEQ ID NO: 18344 - DNA, 440 bp, Homo sapiens
cgatcctggatttgatcctggacttgtaaaggacgttaaagggacagttggcacaatttgtttaggatccatggattagatattattattgtattgatgttaatttcctgattctgattgttttgctacagatacataggaagatgtcttagtttttagaaaatattcactgaaatattaaggagtatcctatctacaacttactctcaaatgattcagaaatgtacatacagagagacagagaacaataaacaagaaagagaatgtaaaatgttataattggggaatctgggtgaaaagtgtacctgatttctctatacaattcttgtaccttctctgtaagtttaaaatcatgttaaaataaaagtttaaaaaattgttatccttaaaatgtaattactgacatacctgttaacaaattaaaacaatgtgttttaaat

SEQ ID NO: 18345 - DNA, 224 bp, Homo sapiens
ttatttcatcattactaaaacttagctgacaatttttattttttcattactaaaacttagctggatgtcagtttctgcctttaaataaaatatccaaatccaggattattctcaattgcaaaaatgcagctggtctcaactattccttttatattttctttcacatagggtagaaaatggtgaatcattgtactttcatataataaaaagatgtcttgaatttt

SEQ ID NO: 18346 - DNA, 843 bp, Homo sapiens
tgtttaggtgggggagggaatatcttaattatcattgtgctccatacgctacagatggcacctgctggccttagcaatatggggtcaagtatgaaacatgatagagtgacacccaaggaacctataaggaaaggaattttgattctttcagaaataacaggaagaaattatcttaaaatcttaaggttgatgctgcaaacaaccagagacaataaataaattgttatttagtgatgttgcagaatattgtgttaatagagcctgtgatctcttctggcaatttcttaccctaagtctgggatttttcctgctgtgcttctcttactagaaacgttaagtgtgcacagatgctcatacgtgtgcagagaaatgcctgaattaactctcacactgccaacattagatcattaaacacactattagtaaatgttctctattttgattttcatgttaagactcatctcttttgctcatagaattaattttatcaatgacatagaaaatggttattttaatacttctctgcactgcggtatcatagctgtgttttgccccaggacttctctctaatgacttgagccagcttgaattagcgtgatgtatcattaatgcatacaaatggcttttatttttgttcataatctgttcataatgccacggcattctgctctttctaatgtttttaaaatgattaagtagtgatgtactttttgacctagttaaccctccatggaatcgatgatcaaaagaataagagaatattacttaactaggatagtcagaagttgttataatctgtagctgatgttttccagttattttgaagttttttataattttttt

SEQ ID NO: 18347 - DNA, 337 bp, Homo sapiens
gtgctcatttgatcctcacagcaaccccagggattaaacagtggggacttagcacacccgttttacagatgaggaaatgttctctgagaagaacctcagagaaggagaacatcatcggtggcctggatttagagagtctgtctaccatcgcctggtcttgagtgatctcagtttggcttttgctaaattccctcaaaactgtgaacattcatcttctcccaggcttagtttgtccctgtcccctctgacctgaacctccatcctgaccaactatcttccataatgaacttaacgacagcagagacttaagcactgtcttgattttatcattgtctcg

SEQ ID NO: 18348 - DNA, 918 bp, Homo sapiens
  misc_feature (918)..(918): n is a, c, g, or t
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaccctaccttaaggaaagccagttgctaagtgagcccatcttgttgaatcactgcaaatacaggaatctgtttaaattcggaggggaaggctgaagttttcgtgttaaacacctccttcctgggggcctaaatgggtttccatgtctgaagatgaatggctan

SEQ ID NO: 18349 - DNA, 3524 bp, Homo sapiens
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaa

SEQ ID NO: 18350 - DNA, 3995 bp, Homo sapiens
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaataaaaaaaaaaaacttttgggcccttttggcccaatgttttttaaatttgggcaagtttttttttggggcccaattttgggctcatttggccatttcccccttatggggggccttttaaaattaatgggcccggttttaaaaaatgggtgctttggaaaaacccctgtggtttcccccatttaaaccctttggagaaaaacccccttttttccaaggggggataatatcaaagggccccacccaaatgcctttttcaaaaagtttgccccccctatatggggctaagtgagaatctgaacccgttatatttttttgtaaaaattccgggataaaattttgttt

SEQ ID NO: 18351 - DNA, 3438 bp, Homo sapiens
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaa

SEQ ID NO: 18352 - DNA, 2695 bp, Homo sapiens
caggcatatagtatcaaatgtattttgttcttttttccccaggtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaa

SEQ ID NO: 18353 - DNA, 2520 bp, Homo sapiens
gggtgggggagtggcaggcgagagggagtcggcaaagagcaaaaggtgtgcgaatggtgaaagccaaggtatatgggcgtcgagagtgagtgaaaaggggagacgggagtgggagccatgtcgggaagagatgcgtggggggtggagggaagacctcttaaggagatgctggagatgccgggctgatagtggaacaaagagaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaa

SEQ ID NO: 18354 - DNA, 1800 bp, Homo sapiens
ccgaggaaaaaaaaaaaaaaaaaaaaatccaactttaaacatctgcttattctatgaaatgaccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggattttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacaaaaa

SEQ ID NO: 18355 - DNA, 1978 bp, Homo sapiens
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctccagcctgaagggtcccaggttaca

SEQ ID NO: 18356 - DNA, 1491 bp, Homo sapiens
agcggggggcatctttgtgcggggccgcgcttcgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagtaatcaccagtcatctgactagaactacagcagtgaacattctcactcaaagaacattgccacctgggtagaatttgagattaggtttcctgtcagtggtgaggtgaatgtaaagaaagttccatgaaccagcattagcatatatgtaaattctcctttttcaaacttacattgcttttctggccatattatgactagtatattgcactactttgaaggtttaaaccaggggtcacaaactttttccaggaagggccaaatagtaaatgttgtaggttttgcaggtcgtatggtctctattgcagttgccaacagacatgggcagtttgtaaatgaatgagcctggcagtgtttttattaaaactttattacggccaggcatggtggctcatgcctgtaatcctagcactttgggaggcgaggcgggtggatcacttgaggtcaggagttcaagaccagcctggccaacatggtgaaaccccgtctctactaaaaacacaaaaattagccgggcatggtggtatgtgccggtagtcccagctactggggaggctgaggcaggagaatcgcttgaacctgggaggcagagattgcagtgagccgagatcacgccattgcactccagcctggcgacagagcaagactccgtctcaaaaataagtaaataaaaataaaaat

SEQ ID NO: 18357 - DNA, 470 bp, Homo sapiens
aaaagattgttaagttgtattgctacatgcatgtatgtggatatgattgccatagggttggttcttgaggctcaaatgaattaatttatataaaatgctgaataatgcttggcacaaggtgagcactcaaatgcagactgctattatcattaaattctgtgctttaacattttcttgttaaatcttgtctctaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctg

SEQ ID NO: 18358 - DNA, 405 bp, Homo sapiens
cacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagcca

SEQ ID NO: 18359 - DNA, 446 bp, Homo sapiens
gttttctcttgaaaaaaatagaatcagtgatgaaatatcagtaagtagtattggaatataaagtctaattttcagaatttgctgataactggcgaaatcaatatggactccatttttgcttattaaaatactaatttttaattttttcctccaaatttatcagtaatacatgcttgttgttgtgacaaacataatatgaagatgtaaaggcaaagccagttgttgaacccccactctctaccaaactacccaatcccatgaggcaaccagtgttaacagcgggttgtatttgtccactcattcccctttgtaataatgtatatacagtacaagtacgtatgcagatatgtagggtttgtgttggttatgaatttttttgcttttactgaaacagataacattttgagtcatacaaataaagaccatttttgttcacaaatgctaaa

SEQ ID NO: 18360 - DNA, 609 bp, Homo sapiens
aaaaaaagaatgtgtatatatatattacattttggggatctctactatatctctgcaggctcactaaatttcacttttgcttttatatgcaaattaacaggaagccctgaataaatgtaaaagctatttctcaacaaaactggagcctttattggggtggagatttctgtttccaccagtactcattagcatcttctgtgtgccaggcagtggggacaacactgtgtccatggcagaaatggatgagacagccgtggcctgagcccctgagtgctggtggtctagtctcaagcaaattcattctgggttcctggcacagacttagggatatgtatgtattgaagcatatgtccagaatgaccttctagtccatattacaaataaattatctaacatttgaaaaaaagagaaacagaagtggagcttctcagacaatgaatattattctggctttcaaacattttatatgtttgatatacgaaatattatataattgttgtaatatatttaaaagaaaccaaaatcttcattggctattccactgaaacaataattacataaaaatagccactagagatccaagtataagttgaactctgattttgtaaa

SEQ ID NO: 18361 - DNA, 395 bp, Homo sapiens
gcgtggggggtggaagggtctctgcatttgtgggaagcaagaagtctgaggctgtgttcatcattctgaaatctctttccaaatgctatgctccatctccatcgcagaatacctgtctgtgacccaaggattcttcttcccaggggcctctccaccaattctatctgcaatagcagtcacctcctccaagctcatctctcacctactggctttatctccctctcctctgctggtcaacagccccagaaactggtccctcagaactaaaggtttatgtcgcagttttcagtctgagacctgagcctttcacaagactgctgggagccatttaatcgagcgctcctcccgtgcccgtcacgggtgctggaagctctccctgcccatctttaattccc

SEQ ID NO: 18362 - DNA, 325 bp, Homo sapiens
aaggggtgcacactgcactagaggaaaagcttcaggaaccaggatctcagaaactctaactggggactcaaagctacagagaactgtctattttgttcactgctatctcagcttctctttgcttttttggtctcaggattttataacaaagagtgtggctgccacaaacctcatgttagaaaccacagcccaaagggcatatttccaccccaagaaatgactctggccctggttgggttgtatgatgtggaccagtctctattagaatgagaattggtcacatatttagtcctgtggccagggagatggtatctgttagccaaaa

SEQ ID NO: 18363 - DNA, 395 bp, Homo sapiens
gcaaaactgagacagcgtacctattacacatcaaactcctcgttcccagttctcctccagcgcctggcagccactattctactttctttctctatgaattacattactctggatatctcttccaatttttattatagcctgcttgacgttgtaaagaaatcaaatgtttggcccagtagccattctcctctctgcttgctccatcacgctgaaaatcaactggtagcttcagctgtagcagacggagccctgagctctcctgacttgtacatgcgcttgtaagtacacaaaatgccctgctccctagtttctgcctgcacgagttcctccatatccctgccccagggcttcctgctttactttctcctcacatcccttcctgtagactccttcgc

SEQ ID NO: 18364 - DNA, 466 bp, Homo sapiens
acccatttccaaataaggccacattctgaggctcctgctggacatatcttttgggtggcgtggtggggtggaacaccattctacccattgcagtggataaggaaagcaaagttcaaacagggaaaatgactcttccaacgtcatgcagtgagaaagtaacaagagctggcatttgaacccaggtcttctgcttaacatatgcctttaattgggtaaaaacaagactcttatggtataactgctgactgttatctggtttgtagaaaatgaaattggtagcttttaccctaggatacctcaaatatcagacaccattttctggaagtatactattgttaacgacattgaaactattagtgccaatgtgaaccccttaaatgggcatcatttatttattttctgtgtcataaatggggaaattaagacctagagggatgattctgctgagagagaaaaagaattaaaa

SEQ ID NO: 18365 - DNA, 484 bp, Homo sapiens
agatacgctcagttaaaaggaaactaagtgaatttgccttgtccccagcacacatacattaaagaatggccaaaggaagttctctaaacacaaattataaaagaaagagtcatggggacgtctggaagtaaggaagaatattataatagtaaaaatatggtaaataaaatttccttctcctcttgaggtttccaaattatgtttgatgactgaagcaaaaattttaacactgtccaatgtagttctcaatgcatgtagataaaatatttatattattaatgagagagggtaaagggatataaatgaaggcaaggtttctaaactttacttgaactggtaaaatatcgatgccagtagactttgataagttatgtatgtaatacctaaagcaactacttaaaaagctgctcagagatacatactgaaaaacactagaaatagaaatgggattctaaaaatgttcaacaaacctatatagagccag

SEQ ID NO: 18366 - DNA, 512 bp, Homo sapiens
caaaggaaggcgctttgtgttttacccatgtctgagggaggggacggcaagaggttgtgcattccagagccgcctccccccgcccccaccagctgggcctccaggtcagactggagaccctgctgccacccccgtggctgtctccatgccccagccctcctgccccccagtcccccacgagggagaccacagagataaaggagctccaggtcccctgcctcctgcccgcgccactgtcaaatctagggccagatcccaggcagaggaggctgcaagcagaacctgtggggtgaggaggagagccctggggggcctcccagcgggaggaggagggggccaggagaaggaggccacaagtctgctggaagataagaagaccccaatccctgaaagacaggcctgggggaagcaacctcagggcacaggtgggggacagaggcctagagaaagacagggacttgtcacccagggcaccaatgagcacttattaaacatctactgagagctacaaa

SEQ ID NO: 18367 - DNA, 662 bp, Homo sapiens
  misc_feature (2)..(2): n is a, c, g, or t
anttcggcacaggattttaggatcagcttgaccatttctggaaaaaaaaaggccattgaaattttatagtaattatgctgaatatatcgatcaattgccaggtgaagattttcctgcttccccattgccttctgccatgattgtaagttccccgaggcctcctcagccatgcttcccaaacagcctgtggaacgagaaaaggccatgtgatgacctggtgagaaggtggcaatctgcaagccaagaagagggctttcaccggaaacaaactcttccagatcttaattgtggatttctagcctccagaatgatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaaa

SEQ ID NO: 18368 - DNA, 546 bp, Homo sapiens
  misc_feature (2)..(2): n is a, c, g, or t
anttcggcacaggattttaggatcagcttgaccatttctggaaaaaaaaaggccattgaaattttatagtaattatgctgaatatatcgatcaattgccaggtgaagattttcctgcttccccattgccttctgccatgattgtaagttccccgaggcctcctcagccatgcttcccaaacagcctgtggaacgatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaaa

SEQ ID NO: 18369 - DNA, 656 bp, Homo sapiens
acttgcattagtttactttgcagtgtttgaactagttgaggagtggctcttctatatctgtaaataatgttgtatctaaccaattaactattagaaagcctggaagataaacatacacattattttgagttatcacatttatcgttttacctagttcctgttggaatatagaaagcaacagctttttgttatctctggaacagcttctatcctagtttaaatcacagatccttactctctttaaaaaaggtcaagcataggtacctaaaaatacccacaataataagaagggaaattgcattccacaagatgattgctcttaaagagtcagaaggagttattggtgcattcctgataccataaatggttaccaaacatttggtaattttgaccaagttcacagtaaggagaaaaaagggtgttggacttgcttttcttgaagattacttatggagcaaccaacctagaaggatgaatctacttgccaataacaacactggatcacagccaaggcagaggtttttgacattcccaattcatcatggtggtgttttgtatttgtaacatgtcttttctccacagatgttgaaaggcatgcttggatgacacatgctaatagtgaaacacgctgaaagtcctgccatcacagatcactt

SEQ ID NO: 18370 - DNA, 396 bp, Homo sapiens
ctctgctgtccagtctggagtccagtggcatgatcttggtgcactgcaacctcatctcatcagctcaagccatcctccctaccttagcctcccgattatctgggaccacaggtacatgccaccacagtttttgtatggctagtttttgtattttttgtagagatgagatttcgccatgttgcccaggagtttgagaccaaccagcctgggcctcatagtgagattccatctctacaaaaaatttttaaaaattagctgcgtgtagtggtttgcacctgtagtcccagctactcaggaagctaaggcaggatcatttgagccaaagttggagcctgtggtgagctatgatcgcaccactacactccaagatgggtgacagagtgagaccctatctct

SEQ ID NO: 18371 - DNA, 418 bp, Homo sapiens
cacttacagagctagtgaagcctagaaagagtccaggccttgctgcagttttcttccagtggcactcagaggggtttgtgttttcagtttctgtattattttttggcctatgcagtatttcgttcttagcattttgcaataaattggtggtctctcaatatttctatgtatctggttttaccatgtcccagttgtgtgatcttggaaaatttacttctgtgttcctctgtttcctctgctgtgaatgtggggatggagggttgtcttcaggagtgaccattctaatatttgccaagatcctagaatggtgcttagcacgttctgagtgggcagcaaacattagatgttctgatttacggttctagctgtccctgtctcttctctcttctgcttgccactgtccccacctacctgagct

SEQ ID NO: 18372 - DNA, 706 bp, Homo sapiens
acaacctcgatcgcttgcatgcgcagttcacaatacagttcacgctcctatgagaacctaatgctgccgctgagcggatgggaggtggagctcaggtggtaatgctcactcgcctgctgctcacttcctgctgtgcggcccggttcctaacaggcctgtacggggaattggggtcccctgctgtagattatctggctagatttaaatttaccgtatttactaatgaagtcagtcattgagtctaatggggctgttgggattagccccaaaaatttagtcagggaaatggatgactcgtacagacttgtatcatcctcagcatataccactgttggaattgaacggtgatacggttattgctcttttgtggaagtcttctcaggaactataaagaggagagcaaaaagaaaggcagtttagtgggaggagaatgttggaggtaaaaaagaaaacaaacaagaaatggtaaaagtaaagggtgtgtatacatcaaaatgaacttcatcttttttattatctactttatttgactttaaatttttattgctatcacttcatctattttctgattttgcctagggctagccctggtataggatgtattatatattttaaaatacaatgtgattttaaagtaataagttaatcgcttcatttaatcattctcttaggctgctaaaagtgttaaatggcaatatattaattg

SEQ ID NO: 18373 - DNA, 566 bp, Homo sapiens
ctccttctacagcccctcacctcgacttcccaccaccgggaaatggcttgtttatccagctccagaatcttacaagttcctggagctcactaacaggtcaagactcgagggcatccataaaacagtgactccttccactaccgccagcaccagccagggcccctccacctctcagctaagttcccgcttctgatttaaagttcatgtgaaaactagagatgatcctgagtcggaatctaccttccaacgtggtggccaggctgttagctcaccaggggtcagcggcctgcctgcctgctttaccacaggttgtggcaaaagcccttaagatcatgtccccgccacacaggttgggcagctttcaggtctcctgggagacagtttcatctgtaccgtggcaagcaaacttcagagctataagcagtaccgggctatggcaagtgtggtgtgctaggaagacaccgtcactcagacatgggcagcgcgtgactggggtctatggaggcctgcacatgaagagttctcagttcttgccttacagcttttctgtaagcttgaaactgctt

SEQ ID NO: 18374 - DNA, 489 bp, Homo sapiens
gaacaagaaagagagagggactttccaaacagatgaacaaaaacctgcagggaataggagatttggataagaattgacaataatttcctgagggtcttgggagttgaggggatatgctagatgagatcagattaggagattagaggccaggtaatcagggtaacctggattttcaggttcattccggagaccagtgtattccttgcttaggaggtatcaaatggaatgttgtgtttttccatacttggttacttggttctaaacaaataaagttattaaaggaccagagaattgagttatttcaagtttgtcagaaatttagtggccctaactggaggctttttcatgacaaataacaaatagatgttgttgagcccagctgtgtgtagatgtgtaggctggtttgtctgatagaggttagtttttattccttaacaagcacagccaccacagactcctcacctttctagcacttaaaaagctcaccct

SEQ ID NO: 18375 - DNA, 491 bp, Homo sapiens
aaacccaggcactcagtgacagcatccacactcataaccacgatgctaagagtttgccagacaggtgagaagcaacatttttggaagagggtcagggccataggttttgtgaagtgacagagcatgacattcagattcagtagggcttaaagaccccaagttttggaaagtagaggagatctgaaccttagccgtagcttctagaggtgggctaagagcaacctgggcacatgtagtggtgaccagaggacttgcagccatcaaatcactatggtgtgctgtttatttctcccaaagactcaggaggggagaggtttgatacttttttctcatatcagataactttaaaatgtagttttatattatagaataggatgtaaaattaccatgacatttttccttgtttcttcttccttttgatatatgatttaaattgtttctttaatgtatttatttatactaaataaaacaactcatggttatataaatta

SEQ ID NO: 18376 - DNA, 396 bp, Homo sapiens
tgtagtgacagggtctcgccatgttgcccaggctggtctcaaactcctggcctcaagtgatcctcctgtcttggcctcccaaaatggtgggattacaggtgatcctcctgtcttggcctcccaaaatggtgcgattacaggtatgaaccactgtgctcagccccaagaaagaaaatctttaaagaacatatacccaacaaaagacttgtatctaatatataaagaattattaaaactcaacagtctatttccccaacttgctcaggcaaaataggaggaaaattaaacagacatttctccaaagaagacaaaacaggtatggtatatggaacaaatgctttatatcattggtcattagtgaatgctacttaaaaccataagaggataccactaaac

SEQ ID NO: 18377 - DNA, 329 bp, Homo sapiens
cttatgcaggtttcactcagcccctctattttcaataagaggcctcatctccttcctcacctacaccagtttcctttgagcccacatcctttctcgtttagcctcttcagagagcaggccttctgttttgtacaggagatcagttgcctagctctgaggttgaggaatgagacactattctctatagattttcaatgcacctgcctgttttttcagtcccacctcagccttccaaagtgctaggattacagatgtgagccactgtgcccagccctttgcccgttttttaacggggtggttttttgtttgttgaattaattttcttatag

SEQ ID NO: 18378 - DNA, 543 bp, Homo sapiens
aacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctg

SEQ ID NO: 18379 - DNA, 360 bp, Homo sapiens
gccagctagtaggactttcactttgttgggagttcctatttcctttttttcctctttgcccaataaattcaatttttctcacccttcaaagtgcctgtgagcctaatctctcctggctatgtgacaaggaccccgtttttagctgaactaaggagaaagtcctacaacataactagatgaggttacggcaggcactaaatctgccccgagtgcttgactcagcctcacttgatccgctgcaacagcctcccctctggactgagatggaagtgggacagctggatgaccatgacattggacctccagtagtgctcgtgaagcgatgcatcttggaaaggaggatctgcctgcgttcctgac

SEQ ID NO: 18380 - DNA, 406 bp, Homo sapiens
  misc_feature (406)..(406): n is a, c, g, or t
gcagtttaattatcttgatttcgagcctcattctcttacattttcactaattttccatattttttctaagtctctgagaagttttgatagtgaattccatcacctttatattagctaagctctcattggctttctaactcaatttatcacatggatattgactttcaaccatgttttcttttttctttttttttttttttcttttgagatgagttttgctcttgttgcctaggctggagtgcaatggcgtgatctcggctcactgcaacctctgcctccagggttcaagcgattctccttactcagctagtggggagtctgagggaggagaatcgcttgaacctgggaggtggaggtcacagtgagccgagatcgtgccacagcgctccagcctgggtgacagagn

SEQ ID NO: 18381 - DNA, 225 bp, Homo sapiens
agaaacagaggtacatggaggttaaataactagcccaaagtcacatagctagtaagtgataaaattcgttggtttttgtctgttgaacaatgaagagaatggtttcctaaaatttgttttgtttagtcactgattcactagttcaatcttaaatgtaattcagtagttcagtcctagaaacagttttcaaagccactaaaaacagatttagatcctagtgaggta

SEQ ID NO: 18382 - DNA, 920 bp, Homo sapiens
  misc_feature (70)..(70): n is a, c, g, or t
  misc_feature (73)..(74): n is a, c, g, or t
agcggagttccaggctctcctgcttctccacggactctgcgggaagttagagcctctgcgtgcgctccgnggnncggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaac

SEQ ID NO: 18383 - DNA, 5258 bp, Homo sapiens
agcggataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgacctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggaccgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 18384 - DNA, 4859 bp, Homo sapiens
  misc_feature (70)..(70): n is a, c, g, or t
  misc_feature (73)..(74): n is a, c, g, or t
agcggagttccaggctctcctgcttctccacggactctgcgggaagttagagcctctgcgtgcgctccgnggnncggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgacctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggaccgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 18385 - DNA, 3838 bp, Homo sapiens
agcggataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgacctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggaccgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgc

SEQ ID NO: 18386 - DNA, 3790 bp, Homo sapiens
agcggataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgacctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaattgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggaccgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgc

SEQ ID NO: 18387 - DNA, 337 bp, Homo sapiens
gtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaa

SEQ ID NO: 18388 - DNA, 3696 bp, Homo sapiens
  misc_feature (2)..(3): n is a, c, g, or t
  misc_feature (6)..(6): n is a, c, g, or t
gnnttnggcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgaaaaaaaact

SEQ ID NO: 18389 - DNA, 3602 bp, Homo sapiens
ggcacgagggcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgaaaaaaaact

SEQ ID NO: 18390 - DNA, 3779 bp, Homo sapiens
  misc_feature (2)..(3): n is a, c, g, or t
  misc_feature (6)..(6): n is a, c, g, or t
gnnttnggcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccagacctctcctagggctctagtgccaaggcccagctgtcccgcagagtgtctgagtggttgacaagttcggattgttccctgaaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgaaaaaaaact

SEQ ID NO: 18391 - DNA, 3325 bp, Homo sapiens
ggcacgagggcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgggttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgaaaaaaaact

SEQ ID NO: 18392 - DNA, 630 bp, Homo sapiens
gtcacctccaggggcttccattctggggtagaactgcatcaggccagaggtctcaaactagtggcccttaggctgaatgaggcacacagacatgattgctttgtaattggatttgagaatctccggcctagactcgcccctcatttgcaatgacccgaagcaccttgggtccctggcttgcctggctggcccctggtacatttgagtttgttttctgtagctgtctgagcttctcttttctttctaggactgattgtgggtgtgacagccttgggtctactaataataggagtggtgaactgtgtcatcatgacccaggtgaaaagtaagagtccatccttccttccttcatccacttgttcaggaagcttttgtggggtgcctcctgtgagtccagcactgggcacagccttaggggtcagacagagctggatatgggggtccttgttctgtaggagcttaaggcctggggtgaaggtacctctgctaacttaattactaaaaggcaagaggtgatcagggttttctaaagggtaggaggagttcaggattcctatccaggaagcctgggggattcgggcttcctgcagcaggtggtctctgagctgggtaagatcttgatgggtggag

SEQ ID NO: 18393 - DNA, 120 bp, Homo sapiens
gtaccaccaggggaagaaaataagagcagttaacttttaggtattctctcaggatgactcactatcattaatttcccttgataggggaaattgaattagcttcatggggattagatggct

SEQ ID NO: 18394 - DNA, 645 bp, Homo sapiens
tacttagcaacttggccacattgacattgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaacttccaagttgtttgaatctggtcatgtgaaaacctatttaagccttggtttccacatctgaagaatggaggtagtctgaagaaaaatataaaaaacagtgaagtgggtactgttactacccccattttgcagatgtgaagagc

SEQ ID NO: 18395 - DNA, 702 bp, Homo sapiens
tacttagcaacttggccacattgacattgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagatttttttttaacagacagggggcggtctcactctgtt

SEQ ID NO: 18396 - DNA, 714 bp, Homo sapiens
ggagggcgtgaccaaggctgcctggatgacggcgggggatggtggaatatatctccccctgccctctccacctgcatgtcccaggtccagccctgcccaagttctatcatttccccacagcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagatttttttttaacagacagggggcggtctcactctgtt

SEQ ID NO: 18397 - DNA, 526 bp, Homo sapiens
ttggctgcgtgcctttctccaggtttccctgtcctgcatgcagggacaagtcattctcctcctgtggctgtcactagccatctgtgtcccatgcctgggacatcctggaccaggcccctcctgccttctgacctttgccagatggcaggagactgccatctcctatcatgtgacctactggacaaagtgcggataagttgaaccatatgaaattgtctaagcggggaaactccaggtcaatgtgtctcctttttctgaaaaaaaaaaaaaaaaaaaaaaaaaaaggtttttctttaagtttctcctccccctgaaacaaggtcataaagaacagagatgcaatctcatcttccctgtctccttccaaccccttctcccatcctctggaccagacggccttgtgcaggcaggctagagggagaataatgaaaccttgagtggggagttatactcccaataacagtggtcgaggtaattaggcctgaatttcccacagaaaataagctggcaaacatgttgaaaaaaa

SEQ ID NO: 18398 - DNA, 242 bp, Homo sapiens
cctctgctaccaccattgcccaaatcaccttggctacctagaaggccttgaacatggtacttgcctggtatatacattgccattacaagtggcatttgagaaagccaccttactaaggctgtttataaccaaagaaatcaaacagagtctatgccactgaacacacctagaagcaaagccaaatgaccctattcaacatacattatagacacattttcagggaaaaataaaagttctacccc

SEQ ID NO: 18399 - DNA, 445 bp, Homo sapiens
attttggtttaagccagaggaatcagactgcccaccaatccacactattagagagtttttaagtgtccatttagtggccagcctttaggctgggcaacttcacacaaaaatgaagttatggggccaggcacggtggctcacacctgtaatctcagcactttgggagaccaacatggaatgatcacttgagcctaggagtcttgaaatgggtctgggcaaggtgatgagaccccatcactacaaaaaaaatttttttaactagccaggcatcatgatgtgcacctatagtcccgggtacttgggaggctgaggcaggaggatcccttgaacccaggaattcaaggcagcagtgagctatgatcgagccactgtactctagcctgggtgacaaagcaagacctcatctctaaataaataaataaataaataaataatgtttttaatg

SEQ ID NO: 18400 - DNA, 284 bp, Homo sapiens
gccatggcttcatcagctactttagccctgttgttggaaagaaaatggtccaagtggtccagtcttcagtcccatctagagatcagctggctctggggtgaagactgcctgactccctcataagtaggtgtgtgaccttgggcttgttgctgaactttcccgtgcctcagtttcttcctctgtaaaatgggaataataatacctagcccacaggatcaaaaaagttaagatatgtaagccttatattaacagcataatacatggtttttgttgttgttgttgtt

SEQ ID NO: 18401 - DNA, 440 bp, Homo sapiens
tttatttaatcctcacattgactccctaaggtagctgtattgtccttatttcacgtatgggaaaattgagattcagagaagttaagtttcccagggacaccgcagatcacgaacagagctgggattcagtccaacttcagagctaatgcactttggaggaagagatacaatctttgccctgggggtcagtatctgatctgatgagaatgtaagagctggggccaaaacaagacaagaacaagagatgagaaatgataatagctaacacttcctggatgcattgctaggtcccaagctttgctctgcactcttacactgaatcttcagacgctagaataaaagctccatgagggcagagactttgttcctctggttctctactctgtatctgccttgagatagatactcaataaatctttgatgaataaagcagctgtgct

SEQ ID NO: 18402 - DNA, 428 bp, Homo sapiens
ggtcagccatttgaaaaaggcctaaaccttcttacacaagtcaattgaaaaggcctgtagaaatcagagctcgaagacacctgttaaatcatctgatctatccctctaccagcggtactcggttgttcatagccctctctaagctgttttcactctccttcctgtgttccagacattcattattttcccagagactggacttgtgttcacccttttaatcatttaagaagggaatgtgacttttcttaactcaaaaaatttcatttattttatatttagactttaattttggaaactgttgataatggcagagattagtaagcatgtggactgttttcctctagattcacaaaaggatttagttgatgaatgtctaacaatagtaattatatgatcagaaagtgacgggaatacaagtcaaatttcat

SEQ ID NO: 18403 - DNA, 104 bp, Homo sapiens
cacaataattctatttatcaggatataaaatctatgtacacaaatcagtagcagtgctatacaccaacatctaccacgctgagaatcaaatcaaacccttttat

SEQ ID NO: 18404 - DNA, 400 bp, Homo sapiens
tttcaatgtggctttgtctagtatagtggatggcctattttccaggacttccaaactttccatttgttattatcccatgtagagggtacaacattttcattataaactgtggctaaaaatattggaaaatacaatctgtgttgctagataatcaaatacaatcctgaaatattttgaagagtttgaaaatttcagagctttatttatataatattttatgtgtatatttctctcaaactatatctaacatttgtatataaatgagaataactctttgtgaaagcaacaagttttacaaagatttttacttttaaattatgcccaaacaagtaatataaataaaagtcattttgaaagtgtttaaacttaataaaagaccttaaatgggaaaaaatagtaa

SEQ ID NO: 18405 - DNA, 355 bp, Homo sapiens
gttaaaataaataacacttgttatgaaaaataactataacacaaatagtgaagagtgacattacatttttcaaatttctgtaatgtctagcttagaagacaaaagagttctcatatctatttgacttgagatattcatgctgctgaaatattttgttttagttgaagttgatgactaaaatccagttgcatatagtatttgagggaagggagtattttaatacatttttatggtaattatagatatgctactttgatactaccctcgaactcaacaattggtagcttcttaaaagttttgcaatgtagattctgaaaccatttcaataaatttgttaactgtacattaaaattaa

SEQ ID NO: 18406 - DNA, 541 bp, Homo sapiens
gaatggcaaaagttaggcagtatttataaggtacctgttttatgttactgatatctgtttccttctcttcttataccctggcatggtggcctgtagggtagtttcttcttaatagtcaagaacagagaaagctgaggagagcagaaaatatcttgcactttaaaatgcttattttgattccatattatctgaatttccagagaggatgtaaacaagagtgaccatatttttggagtccttcttgaagccagaacaacacacagtgggttgctaagagccgacaatcataattgacatttagtgtaccagattattctaagaatttctgaaattaccatgtacatgagtaatgaaacaactgggaataatgtgatgatgtgaacacaattttaaagtctgcttgtctgggatttgcaggtacccttccgccaccccccaacatggtagggtaaggagagcaaaaggggaactggggaaaattcagctacaaataaaatgggtgactaatccccagttcttggacccattatatttgtagcca

SEQ ID NO: 18407 - DNA, 1722 bp, Homo sapiens
cttccattttgcagctgcactgtaccatgcacctggtttctatatagtaacagtgtgcaattctaattatggactgtgccctggtttttagttttcaaatcaatttctaattctggtgatgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaacttta

SEQ ID NO: 18408 - DNA, 2364 bp, Homo sapiens
cttccattttgcagctgcactgtaccatgcacctggtttctatatagtaacagtgtgcaattctaattatggactgtgccctggtttttagttttcaaatcaatttctaattctggtgatgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcatttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttaatattttttagagcaaaattgatggaaagcatttggctgaatctaaagacctgcagtcagattcttcaatgtggtttacccaactggagtagtgataaacaccttaatcataaaatgaataaaaacaaaaaacccgatctttttaataatgctccaa

SEQ ID NO: 18409 - DNA, 867 bp, Homo sapiens
taccgcgacctagaggatcccatcagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaacttta

SEQ ID NO: 18410 - DNA, 2338 bp, Homo sapiens
cttccattttgcagctgcactgtaccatgcacctggtttctatatagtaacagtgtgcaattctaattatggactgtgccctggtttttagttttcaaatcaatttctaattctggtgatgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcatttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttaatattttttagagcaaaattgatggaaagcatttggctgaatctaaagacctgcagtcagattcttcaatgtggtttacccaactggagtagtgataaacacgtagatcttgtcattaaatcctggcaccc

SEQ ID NO: 18411 - DNA, 1625 bp, Homo sapiens
gatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaat

SEQ ID NO: 18412 - DNA, 779 bp, Homo sapiens
gtaaacagatctaactggggaagcctgtgttgtccctagtatttaccctatgacctaatgctctaagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcagcgagattgacttgattgaccttggattcatagcaaaacgttattatccgtatggtttcttccaaaaggaggcttccaaaaatccggaaggaaggttcttggagcaacattcgtgaggatccgtaaacgtgggaacacccgaagacttccaaatccaaggtccttcagagaaacggtcaagcggtggaaggggcacacggacgggggctacaatttttcaacagtccaggtggaacggttgagccatttcgagaagcactcccttctgtggtaacaggaagatatttcttgaaaggttcaaatggcttcccagtttaaagccacacgtttggaagctgggtctgtggaaaagggccaacca

SEQ ID NO: 18413 - DNA, 2542 bp, Homo sapiens
taattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18414 - DNA, 3125 bp, Homo sapiens
ctctttctcttgtatttcttttaataaatgccttaccagaagtttatctctctctttcttcttctctctctgtttttgccatttaaaaatgaacttttggctttatatatcctttgcactatgtcttgttctccatttcattatttatagctttcatttttacaaattgttccatttgttattttctagtttactttgatattcttttatatatttccttgactatttacttggctatttttggtcattcttttaaaatcaggtcttttaaaacatctactcttctaaattcactgacgttttgggtttgaccatattcaggaacttgcatttataaaagcaccctgaaattcttgaaggtttctttaaattaattacactattttctctttaactctttagcaatacaatttccaacataatattaatacattcactgctaaaacgctcacacttattgtttatattttcccagagaaacatcctcatcttccaatgaagtttctgtcatgccagaatgggatcacgagtctctttctttcaaacccaagagtctaacaccacataaattacccagagagctaccaaaaaattcagttacatcattctattttgtgggcttctgggtgtaaagccagtgtcacttttcaaataggctgatatcctgtaggcttgagaaaaggcaaggtctcgttagtgtttatattcactaaagtatcttgctcaagccctggacaccgtagattctaggacactattgactctaggtgtctggtgaaacagtaggcactaaaaattagagaaatcacagttaaatttattttgagccaagtttaaggacttaactcttaacaacacaaactcagtacaacccagaatgtgtcccacagtaggttacctggggcacagtatatataacaggagtatccgtttggcacaggtggtaagagaagcagggagagaagcaattgttgcatttttttattctgctgggtgcttggtgatgctatatataaaatagggtatgtgtgcagttgagtgggtagggagaaaggtgaggcatcttaaggcctggtggagggtgactgatttcatcctgtcttagttctgcatgtgataaggaggtttataaccaatacttgtcagtgttaaatatttaacaaactccagttacacaggtaagaggtcagcggtagcttataggcctaggttttattatcgatgtgcccaactgcagccatcatgggccactgttaaaattttcttttgaactttcatttttctgataattgcaaccagtgagaggtgaagaaaaagttcaagggaatgacctgatcttatatcatccaatacaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18415 - DNA, 2296 bp, Homo sapiens
gatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18416 - DNA, 2460 bp, Homo sapiens
taattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18417 - DNA, 2322 bp, Homo sapiens
taattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18418 - DNA, 2288 bp, Homo sapiens
gctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagatagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18419 - DNA, 2231 bp, Homo sapiens
atatttctggcaccattctgagtgaatcccaacatttccccgtttttgttttcggtatcatgtctttttgatttcagattgcagatatgtacagccataggattgtcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18420 - DNA, 2202 bp, Homo sapiens
taattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataataggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18421 - DNA, 2225 bp, Homo sapiens
taattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattt

SEQ ID NO: 18422 - DNA, 698 bp, Homo sapiens
ctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataataggtaagctccctctcgcattttggagcttcacacgttggtgttttgagctctctgagttgcttggagcaaatttctgatccaaactgggtttggagtcacaacaggaaacagactgggtctaggaacagatttgatcttggaattaactggcctggatccagttagaggcctcttacatctcactgggtcagaaaggaactggtagtaagcagtaatgttgcaggagttataaaatttggcttttgaaaattcacagggatttttg

SEQ ID NO: 18423 - DNA, 422 bp, Homo sapiens
caaagatgtcactgtgtaattacactatataagatcacattatagctgatgggagcaagagattctcctgctggctttgaagaagtcagatagcatgttataaagggggctgtgagacgttcatgtggcaaggaactttgaatgacctgtaagagttgagaatgaactttggctggaaaccagtgaaaaatggatacctcagttatacaagtgcaagaaaatgaaacctgctgacaaccatgtaaactaagctccagaaaaaaagacactggctaacaccatgattgcagccttgtgagactaagattctgagctgagcatcagttaatctatatccagactccttccctacaaatactgtgagttaggtaataactgtgtgttgtttgaagccagtaagtttgtgtaattgttaagcagaa

SEQ ID NO: 18424 - DNA, 1058 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18425 - DNA, 813 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatcccatgtgtaatatcacaagaaattatgggtattacattgaatttggttgtatctggatatcattcactctcattctttcgagc

SEQ ID NO: 18426 - DNA, 783 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatcgtgtatatcacacgagattatggaacgtgacatgttgtttggttgttct

SEQ ID NO: 18427 - DNA, 686 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagtttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18428 - DNA, 695 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactattcctgttgtcagtatatgctccaggttcatcagttgagtaccagtgccagaacttgtatcaacttgagggtaacaatcaaataacatgtagaaacggacaatggtcagaaccaccaaaatgcttaggtaagtactttaatattctcatgg

SEQ ID NO: 18429 - DNA, 415 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcaactgtgtttctttccttttgtggttatttgccacaggatacagacttc

SEQ ID NO: 18430 - DNA, 863 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18431 - DNA, 1314 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagagtcctgctctgtcgcccccaggatggtgtttagtggcatgatctcggctcactgcaacatacccctcctgggttcaagtgattcttctgcctcagcctcccaagtagctgggattacaggtgcgcaccaccacacctggctaatttttgtatttttagtagagatgggctttcgccatgttggccaggctggtctcaaactcctgacctcaagtgatccacctacctcagcctcccaaagtgctggggattacagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18432 - DNA, 1077 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagttttgtgttattttcccagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18433 - DNA, 1002 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18434 - DNA, 1010 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18435 - DNA, 881 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18436 - DNA, 807 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtg

SEQ ID NO: 18437 - DNA, 396 bp, Homo sapiens
gtatgagctaccacacccaaccctctcatacaatttaaagaatctctagattatttataatacctaatacaatgtaaatgctatacaaatagttgttatattgtatttttaattgcattatttttattgttttattgtctttttattgtttttttccgaatatttttgatctgcagttggttgaatcagaggatgtgaaaccagtggggctgaccgtatatatatgtgtgtatacaagtataaatatataaatacaaatatacaatacatatttgtatatacaacattaaccagaatttagctctaactttatcttgagttgttcttagtgattttcttatattctctcaattatttccactgaaactatattaactttgtaaccagaaagtattc

SEQ ID NO: 18438 - DNA, 2055 bp, Homo sapiens
ggggagatactgtaaaccagcagtatctttgtgtcaccaatggtaactgaaagtcatgctgaagtacagattcctgtagcgtgcacagaggcagaggtgcttcctttaccttgcagatgagttgagcggcgtaagatgtttctgttagggttgaatttcatggttatttcagcaacgattttcgtttttgaagttttggcccccccaaaaatgaaagtctgcaacgcatgtttgttaagagaacagtttattctcctgttaggttttggtctttgaggtatggattccagagttggctattctgttagatttagaggtgtggaaaatcttttaacggggagatcctgaaacacggaaacatggcagggaagttagaatttcctgatggtcatttttaacattttaaagtttactttttggttgttgccatttttctagaatccgtgtcttttttggggaaatacagtcctttgaggactagaatttaatgatttctttacacatctaggattttttgagatttagaaaggatatggctttattcctaaggaagtggaggcagcagtttctaggatactctggtttcaaggcatgctaacttggttgtgatgtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtatttcaggatagggccaagggaagctgtcatttctctactaagtctcattgtggaaaagccacaaatgtccctagtacagtaataaggaaaaaaaggctgagcgtggtggctcacacctgtagtcccaggactttcggaaggattgcttgagcccaggagttgcagatcggccaggacaatgtaagaaaaccccatgtattagaaaaaaagaattagccaggcgtgatggtgtgggtctatagtctcagcttgggaggctgaggtggcaggatcgcatatagcccaggagttcgaggctgcagtgagccatgatcgcatcactgcaccctagtctgggcaacagagtctctaaaaagaaa

SEQ ID NO: 18439 - DNA, 527 bp, Homo sapiens
gtcctaaatacagtggggccacactcgctctgaggtccctagagagaatccattctgtggatcttccagcttctgggggctgccagcattcctttactcatgcgagcattcctttaccccagcttctgggggctgcaccactccaatctctgctccctggtcacattgcctcctcttctgtgtgtcaagtctccctctgactcactcttaaaagaacatttgtcaggccgggcacagtggctcatgcctgtggtcccagcaatttgggaggccgaggagggcgaataacttgaggtcaggagtttgagaccagcctggctaacatggtgaaacccttcctctaataaaagtataaaaattatctgggcatgatggcgggcgcttgtagtcccactcctcaggaggctgaggcaggagagttgcttgaacctgggaggcggaggttgcagtgagcagagattgcaccactgcactccaccagcctgggcgaaagaacaagactccatctcaaaaaaaaaaaaaaaaga

SEQ ID NO: 18440 - DNA, 387 bp, Homo sapiens
ataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccgaataacatcagccacccctgagcctgggcctaccagtacagagccatgctcagccatctggagatagaaatgctcaggggtccccaggtagcttggatgtttcactggcccaagtgctcctatcagctgctccttagggcctgtggttttccagact

SEQ ID NO: 18441 - DNA, 337 bp, Homo sapiens
atatacccaatctctagttcccatacttacatctttcatatagaggatagggttggagacattggctgttagaaatcttcgtaaatttttggctgggtgcggtggctcactcctgtaattccagcactttgggaggctgaggaggtggatcacttgaggtcaggagtttgagaccaacctggccaacatgatgaaatcctttctctactaaaaatagaaaaattggtcaggcatgggggtgcatgcctgtaatcccagctactcaggaggctgaggcaggaggatcgcttgaacccaggaggcagaggtgcagtaagccaagatcatgccattgcac

SEQ ID NO: 18442 - DNA, 247 bp, Homo sapiens
catttagagaccatgagttaccccacgctaaattagactcaaactaatgcgttttcatgttttcatttttaaatggcttttctgtctctctgtcaggcatcatgtatgcctcccctgtcttgagttggggctaaaaaatcaagtgactgaacttaaggtaattatttttaaaacaactaaaatgaaagtattatattaataaagtgctgagttttttacatttatttttcctgccagagcaaaaaaa

SEQ ID NO: 18443 - DNA, 412 bp, Homo sapiens
gacatcttgcccatttaccttagaccacttggaaagcattttcctgtagaaaagtcttacagttaattcttcaggtgctcactagatatattttaagaatctttaaagatagatgaaaatctcactagtatgtgtttctatcccaatattttcatcgtataagtgtttctgtagtcactgacctatcaggaagggtcatggcgctccctcattaatctccccctcagaacctgttcctgcaattattatgcatttcctggtctctttgtgcccccgaaatgctctgaaatgcttatttccctcctgcagagtgaacattatttaacgtagtttgttagtaaggaaatgaaactgaagaggtaggaaaggactgtgtgttaaataaaacaacctagaatcctttatttgaagt

SEQ ID NO: 18444 - DNA, 450 bp, Homo sapiens
tctatgggctaggtattcaaaattctgattttgtttcaatcaaatcttgaaaaacttggcatcttaattccgcatacaaacttcagcatacatctcatttcttgagcaatttattgcaaacttgaatatggggagtgtttgaagttgaacaggccacagaaaactgagtcaactctgcagaggattaggattaaattgaggctaaattttcatgttttattaatcatctggtagtaattctttattgaattctttcctatggtgaatctgcccttctctgacattcagtgaaatgtaaattaaaatatatacttgacattcaatgaaaccataaattaaaatatataattgaatgtttttcagtccagagccatgttgaataaaggcagtcaacatgagaaacatttatttaacctatatggttcttaattttaacattatatttatagc

SEQ ID NO: 18445 - DNA, 414 bp, Homo sapiens
tcgtcttaccctgtttagtccatgaggaaagaaaggctcagctcagggaggacatttgcccaaggttacataactggtgggtgcgcgggccaggcctgacatcgggtccacccagatgccaaccttccttactgctcctctccagcgcctcagccagctcccagcctgggacccagaaaggcccagagcccgcgctcatgccagcacacgatatcttcggtactaatccccggatttcattaatctctatcacaggtccaaagaggaggggtcgctgaggctgggctaatctccctcccgagtttgacttccaactttccatgaaggccttagccctattgcatcccatgggaccaagtaaaaaccttaggctcccagaagatcaaggggatgtttatctggcatctagggatc

SEQ ID NO: 18446 - DNA, 510 bp, Homo sapiens
gtctttcacaaatacctcgtctatcatcctgttcagtaaacccactccacttgtaagtctgttttttctctccattggaatcaggtattggagttccagaattgacattttctaaggtttcatcctgtccctcaatataatcccatgaacgagttctatgattactaaaactaacagatggagacgtcagtgctccttgagatgcacttcttggacaatacttcattagcacagaatcttccagtctttcttgggacacactgcgttgccgtatctggacagactggggcactcgatcatgagaggtgcttcgacgtcgtccctgcaaagtagtgcggttggggacgacctggttataatctgtcgtgctttgagatgctgctcttaaactatctaatctttcttgtattgtccgacaacctatgtgcaatcgtctgttatcaatatactctttgtaagttttatagtttttccagtctatgtgctgatgggaatttggcgaatagtgat

SEQ ID NO: 18447 - DNA, 5875 bp, Homo sapiens
ggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccattttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaa

SEQ ID NO: 18448 - DNA, 4438 bp, Homo sapiens
gtagatgctgtgtattgaatgaattgctctgatttaccaattctttaaggctaaataaaacttactttaggtcagtgcctttctacacaaattagtttttgagtttaacatgcacagcaatatggatagtaaacgttatacatttaatacagataattcgggggttttagcccaggaagcattaaacacctgtaactctcctgctcctaaactccgctgccccctaggcttgacttccagggtgtcaggagcacttttcaggcaggatgctgtgcattggtcacctgctctattcttgcactcctggccttgaattgctgtggctcacgctaagcccaagtgattctccatgttctcatcctaactccttccattctagcctcacacttccagggactgaccaaactacatgtttttagttgttctgggtacttctcagtactttatttcatgtggatatttcctgcctcagaccatgaaggtacactcccctcaccatcatgttgcaggtacagaaacagactagaacagtgtatgtctcctttccttcctctgggccatggcattaattaactctgtagatttgacaataatggcaaaattaaacaactcccctcaccaccagattctgtatagcaactaactgttatccttattataatgccatatttcatgttttctgaatactacgtatgtgttgcatttgctggtgttttaaaccaaattacaagttctaattggccttagtaggcccatgaccaagtcccattttgcggacttaacagtaatttcttgttaggaaaaatgagattggatcctggtacctgcactgtttttacagttgtgactatcaccatccaactcatgacaagcaatgtaacttctcattttctttctggtaacttgacagcataagcatctttacaaaacaaaagcagaacatactaagcagattcgcccttaacataccatcaagtacacatggaggtgacgaggatggactaggatgtgttccctcaccagatgtagctcagcctttttccaggcttcctcggacgtagttaaaaccgagcccatctgttttttgttttatcaggaagctcttgcctttctaagctagcttcttgcagtctagacttctctttcctttccctgtaaatgcaggtggcctggaccccagatttgtcccctctttattctccattacatatttgttgtttcagtgtttttatattttcccaaaccactagccaagtatatattagagttacattgctgttccacttaagattagctgagtctgaaaatctgaccccaagagatttcactttggtgatttaggggtagtttaatgaacatgttgtgttgggctttaaagaattaggactttaacagggaagtaaaggaaaaataggatttaaaggggattggagccaaactttaaaagaactttagtgacatgccagttagtgaggacttatcctttaccttcctattcacacaaacacagccataattctctgcccattttgtgggtaacattggattaggttggtgaggagagagagaaaggcagctgctaaagataactgaggatttcctgctaaattcactgggagagcagcattagccagtaatgagccaagcggaaaggctttagaaattagtattgaagaaatgcaataaatacagttttagaaagaatttgaagtgtggctagacatataggtgaattagtggggtggaaatgcaggagataaatgagggctaaagaaagaactttgggaaatacttagagcttgaaatactctgaagggaaagattatcaatgtgtgacttatagagggctaagaaaaatgctaccatttaggacagcagtccccagccattttggcactggagactggtttcgtggaagacaatttttccacggacctgggtagtttccggatgaaactgttccatctcagatctttaggcattagattctcgcaaggactgggcaacctagacccctcacttgcacaattcacaagagggtttgtactactatgagaatctaatgctgctgatctgacaggaggcggagctcaggtggtaatactggctcgcccccgctcacgtcctgctgtgctgcccagttattaataggccatggactggtccacagcctgtggcttggggacccttgatttaattgctcaatggagaaaaaggatagtgaggagttaagctaggcgttctttggccgcaagattttttaaaatcgtatgtccatgccacaccccagaactattaaatatgaatctctggtaatagggcccagccaatgactattaaagctcccccaggtgattccaatgtcatataagacgatacccaggagaatgcaactgccgcaactgccagatgaagccagatttttcctgttaaattttagttttgttttaaattcttgtaatggttatattgctgttgggtgcattattacttttgaagaggagaagttatcaaggtcaactccttcagaggcattcagagtaggtcacttagtaggagtcatgtcatgtttgttagtttgcagaatttaatgcaatatagggaaaataccttgagtgaaagttgggagacctgaggtcttgtcccagcttcaccactccgttcactgtgggcaaatcatcttacctatccagctctcagattcttcatgggcaaaatgagagacattgaccaggtaatcacaggatttctgaaacattagagaaatgagaacatgcagcttccaagtatggaagatcttgagtggcctaaccatagatgaatgtaggttctgctagggaaggaatgtttctcttatgttttctcctatatgcccccagattatttgattattgagtaatagttcacttttaagacttgaaagtagaaagcagaaaagttaggtgatttacccaaggtgacatagtttgtagagctacctacaaatgggactactccaatttggtgatttcctcatgcctgtaattttgtgaagtttctgttggtaaggagatcgacgccttagcacttgattcactgactcctgtatttaggaattttgtaacagcagatggattaatgaaaatcatgcagtaagtctataggaaattaattactcagcttctcctctccattttcttttgatttttcacgagaacctatagttttagagagaaactcctgtacatttgctcaaagaggaggcaggggtagggctcataacaggagaagtttgtgataaacttgtgtggtttcttgtctcttacaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccattttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaa

SEQ ID NO: 18449 - DNA, 224 bp, Homo sapiens
tcgctctagagtgatcccgactccaccatccatcagaagagatgcctggaaatgatttgtcagagcttgactcactgcttctgatggatggtggagtctggaagacgtgacttgcaataacaccactgattccaacatcggcctcagtgcaagaagcatacgatccatcacgctaggtatcagcagtcctatgacggagagaaagtgaaatttctgggtttatt

SEQ ID NO: 18450 - DNA, 5661 bp, Homo sapiens
ctcctactcaccctcccacaggtcactcttgtgccatgcgcacatggcttactgcaggagcgctacgggaaggtgtgtggtgggaatcccatgcagagagaacagcaaggacaaagaccccgaggcaggaccatgtttaggaaactccgggcatccagcgaagctaagggagtaagcaggatcaaagtaggagacaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccattttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaa

SEQ ID NO: 18451 - DNA, 5455 bp, Homo sapiens
ctcctactcaccctcccacaggtcactcttgtgccatgcgcacatggcttactgcaggagcgctacgggaaggtgtgtggtgggaatcccatgcagagagaacagcaaggacaaagaccccgaggcaggaccatgtttaggaaactccgggcatccagcgaagctaagggagtaagcaggatcaaagtaggagacaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaaagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccattttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaa

SEQ ID NO: 18452 - DNA, 1208 bp, Homo sapiens
ggaggaagttaaggctgattgcagaagttggtaacaacacctaatatgatgagctgttttgtttccctttgtttcaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccattttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaa

SEQ ID NO: 18453 - DNA, 3339 bp, Homo sapiens
ctcctactcaccctcccacaggtcactcttgtgccatgcgcacatggcttactgcaggagcgctacgggaaggtgtgtggtgggaatcccatgcagagagaacagcaaggacaaagaccccgaggcaggaccatgtttaggaaactccgggcatccagcgaagctaagggagtaagcaggatcaaagtaggagacaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgatggggaaactgaacagagagaggtaaaatgctcaaagtcatgcatctagcaagtgatgaagccaggattgtgcaagtctctgatgtgtatgagatcaatctgaaactaatactactggtataaaacattaaacataattttgcttgctgccttaatttcgatgacctttttaaataaatgagttggaactatgacccttgacaaaa

SEQ ID NO: 18454 - DNA, 181 bp, Homo sapiens
tccataaaccccgttagtgcctcatcctgtagaccaggtgcctcagacagcctcctggtaacagcatcaggtaaagggattgaaatgttatacgctttttaaagaatatggcctctcttctcacttgccttgattttcttcacattgccttgaaactttttttttaaatttgatgcttccc

SEQ ID NO: 18455 - DNA, 512 bp, Homo sapiens
caatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgttgggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttt

SEQ ID NO: 18456 - DNA, 282 bp, Homo sapiens
aattgactaagaaagtatgtatttgtgtgtgtgaggggtggggttaagagccccacagtagaagtcaacaggtaatatctaaaactgaacaattgggaaatagcaatgcaaagttattatttataaacatggggataaataccagaagcaataaataaaagagttgaaaatggtttgtttcgagggatgaggatctcgagggtgaaaggtcaaggaatggctgtttttcattttattgtacattacaaaatgtgtccattttgcttttatacaaatattagg

SEQ ID NO: 18457 - DNA, 419 bp, Homo sapiens
gtctctgacccagaaatttcactcttaggggtgtgtgtatgtgtgtgtacctgtctgtgaatcttgaatagaataaatcataataagtaaaccaaaagctgtagaatgagtaaataacttaccacatactcattcaatggaattgtatccagtagtgagaataaatgaactgcaacttcttgcttgctataacaaggatgagtcacacaaacatgatattgaatgaataaaaccagatgctcccttccccaaaataaggcaaacttgatctgtggcattagaagtcaatatactggtggccagacgtggtggctcatgcctataatcccagcactttgggaggccaaggcaggcagatcacttgaggtcaggagttcaagagcagcctggccaacacggtaaaaccccatctttactaa

SEQ ID NO: 18458 - DNA, 419 bp, Homo sapiens
tttaggaaaacaggaaatgtgaatacggactacacttctgaaacagaatgattcatcaccactttttaagtaagagtgtgatccatgaaccaccagctttagactcactggaggaaaaaaaaaaaaagagtcctgaggttcagtctagactcaattcctgggaggcacctagacactcttatttcttatcaggtcgtccagataacagcacgtttgagaaccccactaaaggctttctttgaggtctatgacacactacatatcctacagcaaatgacaacaggcaactgtcaccactgttctttgactacttggaaaagtaacggaaaactttttttttttttttttttttttgagacggagtctcgctctgtcccccaggctggagtgcagtggcacgatttccgctcactgcaagc

SEQ ID NO: 18459 - DNA, 383 bp, Homo sapiens
ctaagagacagagtcttgctgtgttgcccagactggagtccagtggcatgatcatagctcactgtagccttccagtgagcaaggaaggaaacaatgaactttccatgggaagagagttgaaataaaggaaggtcatgagaaactcaggctgtgatttcttgagaggaagtcaatgaaatgaactacaggcatgaacaatgaagaaaagttaaaaggataatagagacaacagcttggccgggcatggtggctcacacctgtaatcctagctctcagggaggcagaggcgggaggatagcttgagcccaggagttcaagacctgcctgggcaatatagcgagaccccgttctccacgaaaaggaagaaaaaaaaagacaaaaaa

SEQ ID NO: 18460 - DNA, 399 bp, Homo sapiens
ggcatcagtgctaccattgagatgtccccacaaaagagtgtgtgacagccagatgtgcagcttaatggagactgaaccaggattgtgggtggaacattggcacatgctgcttatggcttgaatagcagctcttgaggaatctatatttctctacctcatgcagaatcttagagctctggctttgtggctccatggctgggggagggagtggagacggaggaacttgtcactgctccatgccccattgttgaaatggaaaatgtggaaatgttaagccgtttctagaggattgtggaaggtaagaattgcttccaaatataaaaatacaaatacaaaagatcacctgatcgtcacagttgggggctttcttgaataaaaatggttatatctctatttctc

SEQ ID NO: 18461 - DNA, 1242 bp, Homo sapiens
ttatcagtaagttccccttgtcccagcctccgctttcacttcccgcgttccctccaccccaaaaaccgccccaacatgtccagagaggggcatctacccagccgcccagccaggggcgaccactttgtgagccccggggagcgggacccgtaccaggcgcgcccagcgggggatgcggtgaccgaggggccgggagcgccgggcaggtaacgtatcctggacctagagtcgggggactttgtttggggcgggaggagcggaacaggggtgggtgtgaacgccggacggcccttccgggactcctgtcccccctccttcgccccactcgcctgcgcgctggaagccaatctgggtgtgtagcgcgaagagcgaaagagaaacttctgcgtgactgactagatgaggctcctcccgagaagccgagataatagaggccccctctcccgccgcccgcctttttctcctcccccggccgctcgctcctgtcgccccacccctcgaaggctgcggaccagccccccacacttccccctacacctctggcgggttcgcgccgtggacgcccccgccctgcgggaggaggggctggcgcggattttagggacttcctgggatgcggagatcggctctgaaccatcccctttctgctgcccggagctggggaagctcgctgtggagcgtctcgcacgtggcaggcaggcagagaacttgctgcaccttctaggaaattgcaatcgatttgtaatgcactttcgctaattgggagttcaaaattaaactttaataaagcattcgtgtcgtctcgtctaattgtgaaagcttccatccgtcctggtagatagactctaagtctcaagttaatggcgctaagctagattttccccccaagtacaattccgtcagccgtcgtcggcgcagctggatttccgtaaggtacagatgttgctaatgacagcttaagcacggatgggcagatagcatacggaatgcaacatgttgccatatggttcctttagcctttcacctccagggatatcaatcacatatattctgggaggaacttaatgactctctgaacagcaaaatgaattacctggtacaatttatatcccttgacctgatacgttataacaacaggaagatagcatctcgcaatttctgtggtataaattgaactacagagctacatttaaaattctacatctatttgtagtttaaggggccctgtcatattctggctgt

SEQ ID NO: 18462 - DNA, 437 bp, Homo sapiens
gatttatatggattacctcattcaagctctgcatagcaactctgttataatcctcatttcacagataagcagacaggctcagagtggtaaagcaatttatcctaggtcacacagccaggaagtggtaaagctggattctgacttcagggcttacaggctccagagtggagtccttaacccttcgcctgaaattggaagctactaatgttggctgcagggagtttaactggcaggaccctctcagcccttggggacctccctatcaccccgtgccccgatctgggctccaaactgggagtggactaggctcctacccacgtctctgtgatcagcccatcttcagatcaggctgtccctctcctagcccgtcgttggagccccagccgggaccatgctgtatgcagatcaccccattaaaatttcatgtggattcaaaa

SEQ ID NO: 18463 - DNA, 629 bp, Homo sapiens
acagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttctgggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaattctaagctgaatgagagtttctgtataacataactggtttctttctttttt

SEQ ID NO: 18464 - DNA, 954 bp, Homo sapiens
acagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacaggttttgacctcatcctatttgtgatacttccctgactttacatctctctttatatagatgagctcatttttgcccccctcttgctcatctaccttctggtgaggatgttcttttccgcatatggcttttttatccccttggaacagtcctttgctagttaatggaatatttaatgagacatttgggagggaaagatagcccttgcctagtccagccttaggcaatttgggggatgggtgattacagaaatgtcaggctcttgggcagtttttcctttatctctgtcacaatcagtagagtaatttttcttctctctcttctacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttctgggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaattctaagctgaatgagagtttctgtataacataactggtttctttctttttt

SEQ ID NO: 18465 - DNA, 347 bp, Homo sapiens
tgttcaagtacacatgaccaaggccaaaggcaacctttgacatgcatcatagaaaaggctgcattccagggaagaacatgaacttcatgtctttcgaattccctggtctacgtcttcaattgcatttcacaggttataataatgataataattaccagcacgtgtgtaatgctttagagctcacaaagcactttcccactcattgtctagtctatggggaatccaccattcccgtctcagagtgaggaagcgatgtccggtgggcccaggtgacctgcccaagccctcggccagtatgggcagaacccagctctgagctgcagcactaccagcttgctcctgccccg

SEQ ID NO: 18466 - DNA, 317 bp, Homo sapiens
aactttttaacatggaacttgagggtccttaaaatctcaaatcaaactagtttaacaacacttgacaatgtccattatgtactccgtgctctttttctattgagtccactatgggacaaccacctgatgtgttttcctgtaccacatgttttttgttcaagctaaactccaaaactgacatgtgttttaccattttgttcattggttacagaactgatgttcccattactgtgcttaacatgctgattcagttcaacactttactgtgctgaattaagtttagcccttaatatattcctcaaagagcacttatgact

SEQ ID NO: 18467 - DNA, 483 bp, Homo sapiens
  misc_feature (6)..(6): n is a, c, g, or t
  misc_feature (32)..(32): n is a, c, g, or t
  misc_feature (79)..(79): n is a, c, g, or t
  misc_feature (86)..(86): n is a, c, g, or t
  misc_feature (116)..(116): n is a, c, g, or t
acccanaaaccccttgggccccttattttaanggcccccccccttggaagaaaatggcccccaaaggaggaccccttgnccccccnatttaaacccccgatttttttttgggttancccctggggaagtaagagttttgaatgaagggtaaaatgtgtccttaaacatgacagacttgatgctggggaagtaactttcacagaaacaattgaagatagtcaataaaattgcatttatatcttggcaaaaaggtaagaaattctcaggtcaggggatgaacaggtagggaattcaaaaataagtacttgataattattgaacattgggttttatatcttcataggataaaagaaaagatcaaggcagcccaagatagtcaagtgggaaaccaaatccctgtcactcttttataaaacaaatccacaaagcccaaaattcattctttgaaaacaccaagaaagtcagctggtctttggtgagact

SEQ ID NO: 18468 - DNA, 408 bp, Homo sapiens
tgcagtcataattttaagttagaagcacccataaatttagtatatagacgacagtgaactttcacttatagcatcaacattgttaaggtcatgatgtacagagcagtcactttcaaattcattaaattgataaaacatgacaacgtcttcagtttaaatactgattttaaaatgcccataaaaaaagtgcaaacaacgtaatctagcagcctatctgttgcatttttaggaatgaccaattcatggtctttatcttggccatgtattcaaagttgggcttttctttctttttttattttaaagacaaatagcagatgtagccattatactgtgtataaatgtcataaaattgtcgttcacagtctaccatacaagtgtatgctgcaaataaaatgaattttactttaa

SEQ ID NO: 18469 - DNA, 167 bp, Homo sapiens
tatgtacagctatgttaaacagtctgaacatgagactttttctttcaagttgaagattattgtcatcgttttaccactaagttggttgagacacttacttgtaatactttaatttttttaaagtgtttttagaaacaagttgtttgaaaaccaattagaaattagaa

SEQ ID NO: 18470 - DNA, 234 bp, Homo sapiens
gagacagagtttctctcccatcacccaggctggagtgcagtggtgtgctctcagctcactacaacctccacctcctgggctcaagcaatcctcctacctgagcctcccaagtagctgagactacagatgtgtaccaccacacccagttaattttcatattattatacttaatttaaaagggaacagctggcctggcacagtggctcacagccgtaatcccagcactttgggagg

SEQ ID NO: 18471 - DNA, 343 bp, Homo sapiens
tcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctccagctgaggagaagaaagtggaagcaaagaaagaagaatccgaggagtctgatgatgacatgggctttggtctttttgactaaacctcttttataacatgttcaataaaaagctgaactttactgcta

SEQ ID NO: 18472 - DNA, 375 bp, Homo sapiens
tcagctgccgccaaggtgctcggtccttccgaggaagctaaggctgcgttggggtgaggccctcacttcatccggtggcgcgtgctctagtcccagctactcgggaggctgaggcggcgactagcaccgcgtccggcagcgccagccctacactcgcccgcgccatggcctctgtctccgagctcgcctgcatctactcggccctcattctgcacgacgatgaggtgacagtcacggaggataagatcaatgcccctcattaaagcagccggtgtaaatgttgaacctttttggcctggcttgtttgcaaaggccctggccaacgtcaacattgggagcctcatctgcaatgtaggggctggtggacctgctcca

SEQ ID NO: 18473 - DNA, 418 bp, Homo sapiens
cggtttagagccaaagtgtcctgcctgcattccagctgtttccatccatgtccatgtcaactggcatctggaactactcgtagcagcatccactcaatataccagcctggaagacaacggagctgtcattctgttaaaaaattaagagaagtacgcagaacctgcctttttctaaatgagaagctttggaagcgactggacacttttggccattgcagtccacaggtagcctctctgggggcaatagacagactttttcacttcttgtatttactccccaaatgcttgattacatagcttgtcacctgtcaggggggccagctagctagttgctgggttgagtggttaatccaatgatttgtatagctggctcactaaggaaatcataggtactcaatatatagctactgaacaattc

SEQ ID NO: 18474 - DNA, 581 bp, Homo sapiens
ctaatgagaaatccgaacttcagagaaactaagttagtagtctgaggtcacacagcaacaaatgggagagctggactttaaaacacatttctgatatcagagccactgcacaggtttctcaaagtggccttgaaatacttgcattagaattacctggtgcatttgaaaatcaaaatgaaagtttctgggtgtcacctcctcactaaatcagaatctcttagggtagggaatacacagtattgaaaactgttggtcacactttgatctcttcagccccatctctactaaaaatacaaaaattagccgggcgtgatggctggtgcctgtaatcccagctacttgggaggctgaggcaggaaaatcacttgaacccaggaggcagaggttgcagtgagccgagactgtgccattgcactccagcctgggcgacaagagcgaaactgtctcaaaaaaaaaggaaaatattgttttgtgagaaatttaaaaagcaggcttcaagaatacatagtgttgaaaaatattggccacattttcatctctttagccctacctctatataataggtttttcctcccccaaat

SEQ ID NO: 18475 - DNA, 712 bp, Homo sapiens
agatatcatctgtatgtgagatgcatctaaggttcatgcttaacacggctgtggctagggtgctaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattaaaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctca

SEQ ID NO: 18476 - DNA, 638 bp, Homo sapiens
agatatcatctgtatgtgagatgcatctaaggttcatgcttaacacggctgtggctagggtgctaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattaaaaggctctctttggaaaaaaatcagaaaaatcaaaagaactgtgaaaaggatgataataatggaaaagaggcctttgtagccttgtgaatgtaatacgtatagtcaccgtgcccagctctctttctcttcttaactgcctgatatattcctattgagaatctgccaggctggctgcgtggctcatctcctttcaaggttcttctctaccttac

SEQ ID NO: 18477 - DNA, 420 bp, Homo sapiens
ctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattaaaaggctctctttgg

SEQ ID NO: 18478 - DNA, 143 bp, Homo sapiens
ggcttcatccctcccattccccacctcattttccaactacccacaccttcccagcttcccactcaagatccgaaatccattatcaggttccatactggctggataaagggattattattttccactgtggaaaaatgtgtctg

SEQ ID NO: 18479 - DNA, 468 bp, Homo sapiens
cattttatagctgaggacagtaaattcagcgaagcagagtgatttgcttaagaacctgctggtgagcagtggggtagggatttgcgcttgggttctccagtctccaaaaatccgtgccttccgcatggcctctgcaccaagccctgcttcactgctcctttgtggactttctggtcgcagctgaggcatccaggcagaaagaccatccctaggtttgtttgaagagggtgttgacgaagagtcacactctaaaatatttgaagggatttattctgagccaaatatttgtgaccatggcccgtgacacagccctcaggaggtcctgagaacatgtgcccaaagtggtcggggcgcagcattttagaaagacacgagacatcaatcaaatacatttaagaaatacattggtttggtccagaaaggtaggacaactcaaagccgggaggaggggagagggtggggcaggag

SEQ ID NO: 18480 - DNA, 888 bp, Homo sapiens
  misc_feature (141)..(141): n is a, c, g, or t
tatctgccgcctttgtggagtggttttttattgatcgtctccctcgaagggggcgtgtgttattagatcctcgctggtttgggtggtggttgttgctcccccacagtatgtgtgtttcggcccccccgtggcgcgcagtantgttgggagttccctctcttctgccgacgatgtgttgtcctcctgcgttgtgtgcgccgttgtgtttttccccccgcttgctctgggctggttggtgtgttttgtatgtcgcggccgccctctgtgtcccgtctgttattattagctggcccctctcctcattggggggcccctcctctgtgttacaacgaacatagtgctggcgtgtggtgcgtcttttcttgtggcgccccccggcgggggattttttggggcgcgcgcgcgccccccgctttttgttttttgtttttgtttttttgttgttgttttttttttttttttttgttttgttttgttttttttgtggtctaatttctctctttttttttttttttttttaagagacagtctgactgtgttgcccaggctggagtgcagtggctcttcacagactcagtcacggcacactatagcctcaaactcccgggctcaagggagcctcccacatcagtctcccaagtagctgaaggagtgcgccactgcagctaactatcaggttgttgaaaaagtaattgcaatttttgccccttttttgtggcaggggggcctccctcatgaagatgccacccctaatagggctacatggcccttgcagtctgccttggctgatctcagggagaattgtggggtggggaggtagccttggattttgccatatggcgaaaaccgcaattacctttgcacccactgtaaaaagtttttgttgtc

SEQ ID NO: 18481 - DNA, 504 bp, Homo sapiens
atactctctattccttctggcaaagattccccaaaaaagccaaagtaaaaaggatccaagtagaaaaggcagcaagggaaaaatgcaaaaaaccaaaaaacacgcacaatttcctggataactgaatagttattctgaaatgctttaaaaattaaatttacatacaaaaattattttagccctatttttaaataaagcacctattctagaggagataaaaaaaagatttgtaggctaggcacgtggctcacccctataattccagcactatggaaggatgaggtgggagaatcgtttgagcccaggagtttgagaccagcctgggaacgatgagaccagtctcatcaaaaaaagttagccaggtgtggtggcacacacctgtggtcccagctacttgggaggctaaagtgggaagaggctccttgagcccaggagtttgaggttacagtgtgcgattgcagcactgcactccagcctgggcgacagagtgaaaccccatcttta

SEQ ID NO: 18482 - DNA, 375 bp, Homo sapiens
  misc_feature (171)..(171): n is a, c, g, or t
ccttgatctgctgctcctatcacagttcaccagctagagaaatgtgatgcatgcaaggatataaaccaggctgatgtgggctgcagggctacagggctgcagggccggagggcatgtccatgcagaacacctgtgattcaccggtgtgcaagctcaggggctcccgggagntagatggcagagccagatctgcagccctgagctgtgtcttccttctgccataccactctcttcttgaacagaccaggtagctgctatttcaaaatgcaaccattccatcttctagtctaactctcccaggacagcccttctggaattgggagccggtgcccagagtctgccagctgctgggataaactacctgagtttcttcaa

SEQ ID NO: 18483 - DNA, 768 bp, Homo sapiens
ccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaataccttggggagatacttccagactaagtgaatgtctgtttcacttccaagttttacccacttttttttttttttttgagatggagtctcacttttgccgaggctgtagtgcaatggcgccatctcagctcactgcaacctccgcctcccaggttcaagcaattcccccgtctcagcctcccaagtagctgggattacaggcacgcgccaccatgcccaggtaattttttttatttttagtagagacggggtttcaccgtgttgcccaggcgcaggcaaagagaacgatggtgctgtcatgaaataaaattacaacatagctaccttggggaacaaacaaaaacaacaacaccaacaacactcatcaaaaacaaaacaagggggggggccaaaaaaaaatccg

SEQ ID NO: 18484 - DNA, 2470 bp, Homo sapiens
ccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaataccttggggagatacttccagactaagtgaatgtctgtttcacttccaagttttacccacttttttttttttttttgagatggagtctcacttttgccgaggctgtagtgcaatggcgccatctcagctcactgcaacctccgcctcccaggttcaagcaattcccccgtctcagcctcccaagtagctgggattacaggcacgcgccaccatgcccaggtaattttttttatttttagtagagacggggtttcaccgtgttgcccaggctggtctccaactcctgagctcaggcagtccacctgcctcagcctcccaaggtgctaggattacaggcgtgagccaccgtgcccggcctacccactaattaatttcagcatccactggtgggtcttgcaatgcagtaattattaacttagttttcaaaggtgatttttgcattttcctcattcctttgacgtttattaattggaattcatctctaagaaagagcagtcccttcagcttttttcccttttttttttttgagacagggtcttgctctgcggctcaggctgcagtgcagtggctcgatcacggctcactgcagcctcgacctcccgggctcacgtgatctcccatctcagcctcctgagtaaccagaaccacaggtgctcaccaccatgcccagctgactttttgtattttttgtagagatggggtttacccatgttgctcaggctggtctcaaattttcgagctcaagtgatccgcccgccttggcctcccaaaaggcatgagccactgcgcctgacctacgatttctttctttatatatcagtatgaacgcaagggctgtttgttggattctgtgagtcataatctgatactgtttccacgctttggccattgggagctcctggagattgtctcctgtgccctatccttatttaagcacttgtttattttgggatgtcttcagttttccttgtcccagctctgcacccagctgcttctccagggagccctccctcactggagactgggatttagcaaccaagacctgggcactggctgtgcttgttgcttctgggccctcctgggacagagctgggaagtggatctatgacacgtgcttgtgcatttacccgccctgttggtttctgtagctgtctagttcctgctgttcctgtctcacctgcccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactgttgtttttgtgtttgacctgtagcatctaagtactggtttcaaaagttgcctagatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaataaagccatgaaagtaccaagaaataaatcttctcattttaattacatcagcttgtctgtgatcatgtagcctaaggtaggcccagagttaatttttgtgttatctatacacgttattgaagcgaattataaaatgttttagcatgttaattacttgtaaattaatatctacatataaaaatgtgagcatatattctatttagtatattaatccttcataaacaagtaatgcaagttagtattaatgatatcttaagacttaacattccttttttagtttgtgttgaataaatgaacatctaagagttcatgatgatgcttaaggaaagaagcctcatgtttacctttggaagttgtaaggcactgactcataaaaattggcaaataaaaggaaagaatcgggca

SEQ ID NO: 18485 - DNA, 2734 bp, Homo sapiens
ccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaataccttggggagatacttccagactaagtgaatgtctgtttcacttccaagttttacccacttttttttttttttttgagatggagtctcacttttgccgaggctgtagtgcaatggcgccatctcagctcactgcaacctccgcctcccaggttcaagcaattcccccgtctcagcctcccaagtagctgggattacaggcacgcgccaccatgcccaggtaattttttttatttttagtagagacggggtttcaccgtgttgcccaggctggtctccaactcctgagctcaggcagtccacctgcctcagcctcccaaggtgctaggattacaggcgtgagccaccgtgcccggcctacccactaattaatttcagcatccactggtgggtcttgcaatgcagtaattattaacttagttttcaaaggtgatttttgcattttcctcattcctttgacgtttattaattggaattcatctctaagaaagagcagtcccttcagcttttttcccttttttttttttgagacagggtcttgctctgcggctcaggctgcagtgcagtggctcgatcacggctcactgcagcctcgacctcccgggctcacgtgatctcccatctcagcctcctgagtaaccagaaccacaggtgctcaccaccatgcccagctgactttttgtattttttgtagagatggggtttacccatgttgctcaggctggtctcaaattttcgagctcaagtgatccgcccgccttggcctcccaaaaggcatgagccactgcgcctgacctacgatttctttctttatatatcagtatgaacgcaagggctgtttgttggattctgtgagtcataatctgatactgtttccacgctttggccattgggagctcctggagattgtctcctgtgccctatccttatttaagcacttgtttattttgggatgtcttcagttttccttgtcccagctctgcacccagctgcttctccagggagccctccctcactggagactgggatttagcaaccaagacctgggcactggctgtgcttgttgcttctgggccctcctgggacagagctgggaagtggatctatgacacgtgcttgtgcatttacccgccctgttggtttctgtagctgtctagttcctgctgttcctgtctcacctgcccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactgttgtttttgtgtttgacctgtagcatctaagtactggtttcaaaagttgcctagatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaataaagccatgaaagtaccaagaaataaatcttctcattttaattacatcagcttgtctgtgatcatgtagcctaaggtaggcccagagttaatttttgtgttatctatacacgttattgaagcgaattataaaatgttttagcatgttaattacttgtaaattaatatctacatataaaaatgtgagcatatattctatttagtatattaatccttcataaacaagtaatgcaagttagtattaatgatatcttaagacttaacattccttttttagtttgtgttgaataaatgaacatctaagagttcatgatgatgcttaaggaaagaagcctcatgtttacctttggaagttgtaaggcactgactcataaaaattggcaaataaaaggaaagaatcgggcaacaaaaaacaccaacaaccacaagggggggggcaaaaattacccgaggggccaagtttggttacccagtttttgccaaaggggccaagaggagggtaaaagaagaaggggggtacagtctgaggaacgtcttggtttgggagactttcgggggatataggaacaccaattagtcaggaaacattaatgtagggaccgttttgcgattttctaatataacttggtatgtgaaaagatatagagacattagataagaagtcttatc

SEQ ID NO: 18486 - DNA, 2362 bp, Homo sapiens
ccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaataccttggggagatacttccagactaagtgaatgtctgtttcacttccaagttttacccacttttttttttttttttgagatggagtctcacttttgccgaggctgtagtgcaatggcgccatctcagctcactgcaacctccgcctcccaggttcaagcaattcccccgtctcagcctcccaagtagctgggattacaggcacgcgccaccatgcccaggtaattttttttatttttagtagagacggggtttcaccgtgttgcccaggctggtctccaactcctgagctcaggcagtccacctgcctcagcctcccaaggtgctaggattacaggcgtgagccaccgtgcccggcctacccactaattaatttcagcatccactggtgggtcttgcaatgcagtaattattaacttagttttcaaaggtgatttttgcattttcctcattcctttgacgtttattaattggaattcatctctaagaaagagcagtcccttcagcttttttcccttttttttttttgagacagggtcttgctctgcggctcaggctgcagtgcagtggctcgatcacggctcactgcagcctcgacctcccgggctcacgtgatctcccatctcagcctcctgagtaaccagaaccacaggtgctcaccaccatgcccagctgactttttgtattttttgtagagatggggtttacccatgttgctcaggctggtctcaaattttcgagctcaagtgatccgcccgccttggcctcccaaaaggcatgagccactgcgcctgacctacgatttctttctttatatatcagtatgaacgcaagggctgtttgttggattctgtgagtcataatctgatactgtttccacgctttggccattgggagctcctggagattgtctcctgtgccctatccttatttaagcacttgtttattttgggatgtcttcagttttccttgtcccagctctgcacccagctgcttctccagggagccctccctcactggagactgggatttagcaaccaagacctgggcactggctgtgcttgttgcttctgggccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactgttgtttttgtgtttgacctgtagcatctaagtactggtttcaaaagttgcctagatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaataaagccatgaaagtaccaagaaataaatcttctcattttaattacatcagcttgtctgtgatcatgtagcctaaggtaggcccagagttaatttttgtgttatctatacacgttattgaagcgaattataaaatgttttagcatgttaattacttgtaaattaatatctacatataaaaatgtgagcatatattctatttagtatattaatccttcataaacaagtaatgcaagttagtattaatgatatcttaagacttaacattccttttttagtttgtgttgaataaatgaacatctaagagttcatgatgatgcttaaggaaagaagcctcatgtttacctttggaagttgtaaggcactgactcataaaaattggcaaataaaaggaaagaatcgggca

SEQ ID NO: 18487 - DNA, 421 bp, Homo sapiens
tgggaggctgaggtggggggatcacctgaggtcaggagtttgagaccaacctggtcaacagagtgaaaccccatctctactaaaaatacaaaaaattagccacacatggtgggtgggtgcctgtaatcctagctactcgggaggctgaggcaggagaattgtttgaacccaggaggcagaggttgaagtgagccgagattgcaccattgtactccagcctgggcaacaacagcgaaactctgtctcaagaatagttaatgataataaatgaataaataaataaataaatagtggtttaaagaagtaacttcaaagtatacctggcacattggggtgtctagtaatttattttaaatatcccaagaaaaaaatccaattgaattatttgattcaaataccctatttttttcagagtaaaaaa

SEQ ID NO: 18488 - DNA, 169 bp, Homo sapiens
gcatgacctcgcccgtgcctgcctcacctgcacccacccttgcccgctaattgccatttgggctccgagggatgcatctccaaccccaaatctgtcaggcccttgcccagagctgcccttgttttctttctcttctattttttcctatgcgcaaaaagatctcaccaca

SEQ ID NO: 18489 - DNA, 808 bp, Homo sapiens
cagagctcaaagacatcatttagtatggctggggaatgacaagactttaaaatgcctattggcaaaacacattgataaagttataccaagtccattaacttctctgggaaatatttctagctagaggaaaaatgcctggattctggaagcagggatggtggagtggaaatgacagcacaccagtctcagctcagccattatccacacgtgttcatcccagcaagttgcttcatgcttctaggctttgtgtcatcatccatagtatagagtgtttctagattgcctaatgtcactcacactacgtcgctgggcaggtgtgtggtacactagctctaacatcaagcagacctgagtttgaatcctggctccgtcttcaagcaatgggctcttgggcaagtaattttcccatctgtaaaaatggagatgataatacctacctcagggtctttgcccttattgttcattctcctggggacagtctttcccagatatccacaaaggtcactcttttacctccttcaggtcttcactcaacttacctttttgtgagaactttcttgaacacaatagctaaacttgtaaaccatctggcatttcctatcctctttcctcattttattattttccttagcactcaatacctaacatactatatagcactcaattatcttatttattgcctctttcccacctctagaatgtatgctctataagggcaggattttttgtattctttactgctgtatccccagtttctagaatgatttaggtgattaataaatatttcttgcataaatgaattttttgt

SEQ ID NO: 18490 - DNA, 712 bp, Homo sapiens
actcgtggccccccggtggcaagggagagggcgccctgggtccaaccagtggggtggggcaggtgaggaagatgggagtggacaggcagcaccccctggcatgcccctgagaggagaggttaggtggggaggggaggccctgttttcaggaggagacgcgcctgcctggtggtgtctttgtgtggttataagagcaataaagttcctatccttaaaaaatgggaaagtatggataaaagaaggaaataaactttacctattattccatcgctcagagaaaacagttcccattttagtgtagtttctttctgtaagtttggtgaactcagacctgccttttggctgtccctaagcactctagactcatggggtcaccttatcttaatatgcaatggaacccttttgagtcccctcccccatatgtaggaaaccctggtcactctttgctccaatgccttgtttcctgggacttctcagggtagccccatccctcattttttcgccacagcaccaagcacggaaggtcactgtaggaagcagatttttctctgtgcagccatcccatccttagtgtctctcagcaccctgccgcagggaatttctccctggctgacctcagcttccagcccccttctccgcttctgggtgctaaggtgcctcccttctccctggtctctccctttcttgccttctaccccctgcagcctactcc

SEQ ID NO: 18491 - DNA, 445 bp, Homo sapiens
tctgctcagttaataacacattaaagatcaaattttatagtgtgtacacatggacacagtagaataataggcattggagacttggaaaggtgggagcatgggagaggggtaggggatgagaaattatctgatgggtacagtgtacatcaatcttgtccaacccacggcgcaggacggtttgattgtggcccaacactaatttgtaaactttcttaaaacatgagttgttgttttttttttttaagctcatcacctgtcgttagtgttagtgtattttatgtgtggcccaagacaattcttcttccgttgtggcccagggaagccaaaagattggacacccctgtccaccattggagtgatggtgacacttaagagcccagacttcaccactgtgcaagaaattcatgtagcaaaactgcagctgtatctcttaactataaaaata

SEQ ID NO: 18492 - DNA, 550 bp, Homo sapiens
cttttaatttcctttaataacgattcttttttttgcattcacagcttgactatttggtactagagacctagcttttggcctattgcagttttcatatgtctttcttactaagcctaatcatttctagatttcgattgaaagggagagacatgtgactcttcctttcatttaaacacttaaaggccattgtgggattattaataggcctaatttaaatatcgttatgcctcagggaatagggaagccccagcagagggggagagatgggggaaaaactggtcagttgagcagtcagaacacgtacaatgtgtatctgagtttgccatcttctatagacagagtttgtgacaccccaaaacaattacaatagttacatcaaagatcactaatcacagctcaccatatcagatatgataatgaaaatgttttaaatattgtgggaattactaaatgtgacacagagacaccgagtgcgcacatgctgttggaaaatgataccaatagatttgctcgatataaagttgccacaaaactttaatttgtaaaaaaa

SEQ ID NO: 18493 - DNA, 2164 bp, Homo sapiens
  misc_feature (1922)..(1922): n is a, c, g, or t
aacagaaaaatccattagtattaaccattatctttcatttgtggattcttacactgtttcaatggaagtgccttctccccagaaggaaatagaaaatgtgaaatatgaaaagaaaaaatacagggttaacaatattttctaaattactggtaacctgataagaattcatattaatttttgacactaaactaacttaagtataaagccatttttgttaaataaatgagtagatgatacttagattcccatctttactgtttgtttaaatataatttgcttgttacagtataaaaccaactagtttgtatcaaagcttggatactttatcctagtaaacattctgtctaccttgagtaaaaattctggtaaacagtttttttttaatcagaagaacacttttttcattaaaaagaagagctccatttaaaaaacaaacttcatttctagctctaaaatataacaagggttaattaaatctagactaaacaaaattaaacagttatcctgtaatagttaatagcctgttgtttgagtagctaaatgatttaaaaaacagatcaagtacattgatacctttgtatatttatttttgcaggtgaaaaaagccaagatgcaggaatcaggagagcaaactataaggtatgtaaagtttgctttctttttaatgaactactcataagttttgtttttttttttcacatgctgattagcgtatgggcatgctttgccctctttttggttcttaccatcagctgttacattttgaaattatttggtttaagattaaaatttcctttccaaatagttttttcctgaaacttgtgcactgatttgttcttatgcattcattatttattcaacaatatgtaccaaactcatgttgtatatcaggcactgtgctacatagaggagacttaatggtaaagatgaaaagcaccatattcttcagtcagacgtacaatatacagaataggaagcataagcgaaataaataaaatccaagagatttggtattaattaccaaatggttatgaaatgacttagtcattaaccccactcctcttatagaaaagaggaagcttgcgcctggcacggtcgctcacgcctgtaatcccagcactttgggaggctgaggcgggcagatcacgaggtcaggagatcgagaccatcctggctaacacggtgaaaccccgtctctactaaaaatacaaaattattaaccgggcgtgttggcgggcgcctgtggtcccagctactcaggaggctgaggcaggagaatggtgtgaacctgggaggtggagcttgcggtgagctgagatcgcgccactgcactccagcctgggcgacagagcgagactctgtctcaaaaaaaaaaaaaaaaagagaaaagaggcagcttgtttgcacctcacagtttggcttcttcataccatggttttcagttttccacagttcttaccttctgtcgtttgtgcaccaaccatatgagccagtaactgcatcacctctaccacattaatttcaagaatcctacacttttacctccacacactatcatcccggctcatttattctagaactgccatgctagccatatgatgtcttaaactatcaattaaatcatctgtcatcttttcaccatcaccccttaaaaagaactttagtttcttccttataagagaccaacatggcggaaccttgtttctactaaaaacacaaaaattagctcggcgtggtgacttgagcctataatcccagctacttgggagactgaggcaggagaatggcttgaacccacgaggcggaggttacagtgagccaagaatgcgccactgcactccagcctgggcgacaaagactctgtctcaaaaaaaaaaaggaacttaactggccaggtgtggtggctccacttttggaggtcnaggtgggcagatcgcttgagttcagtagtttgagaccagcctgggcgacatagcaagatgctgtctctataaaaaacacaaaaacaattatccaggaatggtggtgcacacctttagtcccagctactcggggctgaggcaggaggattgcttgagcccaggggccagaagttgtggtgagccaagattgcgccactgaactccatcctgggttggtggcagagcaagatgctgtctcattt

SEQ ID NO: 18494 - DNA, 427 bp, Homo sapiens
ctaagttgttgctgtgtgtccactaagataacaaaaatgagtagaatctctgccctttaatatagaaagtaaatgaacatgaaataatgagtagtagctgaacattggctctgaacagtataataccaggtcctttaaagttaatttttaataattaaattctaaagagttggcacatacgaattcttgctcccaggttggtttagtttcaccttttcttttcccttttactcccttatagaaagaattgtgtgaatgttctgatcactaccacccagctggttccagccctggccaaggttctcctatatggactaggagaaatatttcctattgagaacatctatagtgctaccaaaattggtatggtttctatgctgtttcttgtcactggccttgcaataaaactttctactcatgaaaaaaa

SEQ ID NO: 18495 - DNA, 2402 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataaca

SEQ ID NO: 18496 - DNA, 1769 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtatggtttctatgctgtttcttgtcactggccttgcaataaaactttctactcatgaaaaaaa

SEQ ID NO: 18497 - DNA, 1837 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagagacatagtcctcactcaggaactgaaagttctgtgaagaatttgacctgaatgtgttcctgccccccaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtatggtttctatgctgtttcttgtcactggccttgcaataaaactttctactcatgaaaaaaa

SEQ ID NO: 18498 - DNA, 2332 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgggtatttctgtgggacttggatgaaaccatcatcatcttccactcacttcttactggatcctatgcccagaaatatggaaaggacccaacagtagtgattggctcaggtttaacaatggaagaaatgatttttgaagtggctgatactcatctatttttcaatgacttagagacatagtcctcactcaggaactgaaagttctgtgaagaatttgacctgaatgtgttcctgccccccaggagtgtgaccaggtacatgtggaagatgtggcttctgatgacaatggccaagacttgagcaactacagtttctcaacagatggtttcagtggctcaggaggtagtggcagccatggttcatctgtgggtgttcagggaggtgtggactggatgaggaaactagctttccgctaccggaaagtgagagaaatctatgataagcataaaagcaacgtgggtggtctcctcagtccccagaggaaggaagcactgcagagattaagagcagaaattgaagttttaacagattcctggttaggaactgcattaaagtccttacttctcatccagtccagaaagaattgtgtgaatgttctgatcactaccacccagctggttccagccctggccaaggttctcctatatggactaggagaaatatttcctattgagaacatctatagtgctaccaaaattggtaaggagagctgctttgagagaattgtgtcaaggtttggaaagaaagtcacatatgtagtgattggagatggacgagatgaagaaattgcagccaaacagcacaacatgcctttctggaggatcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataaca

SEQ ID NO: 18499 - DNA, 1228 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaagtatgagaagaaactgatttagttacctactttgttctttctcacttcttaagtttatcaaacatgtttttgaagctcacagagataatgtgcactatgttatgtgccctttaattcctgagcaaaataaactaaattggccacgttaaaaaaa

SEQ ID NO: 18500 - DNA, 1263 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttggtgcattgtggccaggtatgaaacctgaaagtggtttaattcagactccatctccaagtcaacacagtgttcttacctgcactacagggttaaccacaagccagccaagcccagcacattattcttatcccattcaagcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaagtatgagaagaaactgatttagttacctactttgttctttctcacttcttaagtttatcaaacatgtttttgaagctcacagagataatgtgcactatgttatgtgccctttaattcctgagcaaaataaacagagatgcggccagacctacctctccacaaccaaccgacaccccacggatacactac

SEQ ID NO: 18501 - DNA, 1090 bp, Homo sapiens
gggtcacgctaacgccgcggtttcctccgctcgattggttctactgtgggtctggactgatctccatgtcctgttgtggggcttttacagcctttggattgtgaaaactgctgagagagacttgcaatccagtcacataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagactcaaccctatgctgtctaccctcaggcaacccaaacgtatggactacctccttttgcttcaagcacaaatgccagcctgatatctacttcttctacaattgccaatattccagcagcagcagtagccagcatctcaaaccaggattatcccacctatactattcttggtcagaatcagtaccaggcctgctaccccagctccagctttggagtcacaggtcagactaacagtgatgcagagagcaccacattagcagcaaccacataccagtcggagaagcctagtgtcatggcgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaagtatgagaagaaactgatttagttacctactttgttctttctcacttcttaagtttatcaaacatgtttttgaagctcacagagataatgtgcactatgttatgtgccctttaattcctgagcaaaataaactaaattggccacgttaaaaaaa

SEQ ID NO: 18502 - DNA, 361 bp, Homo sapiens
taagatgcctggggacgcaagggatgcagggctgcgtcctccgccccggagtcatgctgccctgttcttcaagaataaacagtaacagagacgggcagaacccacgtcttctcagttccaccccaggagcatagggagaggcccacatgccaggatgcggggacacgggagctcacgggaagcaagagtaccaggtgcccagaggtcctaaggccagctcaggacaaaggcgcagagctcaggctgtcgcttctagattgctctgcttttcaacgtggtgctcattgattgcagtcactcttccctaagtgccatcatccccgggcggcccagccaggactcagagtgcagacagccacac

SEQ ID NO: 18503 - DNA, 425 bp, Homo sapiens
atgaggattcaggtttccagtcaatttcagtatgaataattccagcctgtaacaagaacaaacagtgaatgaatgagttaatttgagttgtttgaaaataagaatgttttccataaagagatcattgaactcattagttaacacgccatggtgatttctggcttgacactggtcacaacatttaaaagtaaaaagaatgacccagcagatttacaaattaggtgcatatagaatttaaggtcaggatattcaagcaatcacaaccagtgatattacattgagaggtgaagccagctggacttcctgggtggagtggagatttgcaagaatttggcttgctaatgatgctattaaaagataaactaaagttgatatactgtattattgcatagactatttgtccatgttagtgttcaaaaatgcca

SEQ ID NO: 18504 - DNA, 467 bp, Homo sapiens
gcagttcagacatgtaaagaaatacaactgtatttctttaaaacaaagtacactgtaaggaaaagtacaaaaaaagtacactgtaaagaaaagtacactgtaaaggcatgacatggcatagtcccatgatatctctctctttttggagacccagcattcagtgtgggctcctctgagagctcagtggtacagttaaaacttaaagactaaatttagaactacttatttaaataaaatgggtcccattataaaatcctttggtagatttttataattttatgtttgacttggcatacatttttaatcttcctctaacacaaccagactttctctctctgtattttgatatgtaaatttttgctatctgtgtttcacgttagaggtgtttctttagtatgcaaatttagggctatctagctgacaattgccttggatagtgaaataagttctcaaaaaattggaagtct

SEQ ID NO: 18505 - DNA, 438 bp, Homo sapiens
tatattccactcatggcatttatgatgttatattattatggtctattcccatgtctgtttctgccaccagatcattccattcttggagtcagggattagggcttattaattttaaatcccaaacacaagatggattaaaagaattattggaggccgggcacggtggctcacgcctgtaatcccagcactttgggaggccgaggcgggcggatcacaaggtcaggagattgagaccatcctggctaacacggtgaaaccccgtctctactaaaaatacaaaaaattagccgggcatagcggcgggcacctgtagtcccagctactcgggaggcagaggcgggagaatggcgtgaacccgggaggcggagcttgcagtgagccgagattgcggcactgcattccaacctgagcgacagagccagactccgtctcaaaaaa

SEQ ID NO: 18506 - DNA, 368 bp, Homo sapiens
tgggattataggcctgagccacggtacctggcctatttttctactttttaggagagagtccttccctttggtcagtgtccgttcattttggctgctgttagagaataccataaactagatggcttataaacaacagaagtttatttatcacatttgtggaggttagggggtccaagaccaaggtgccagaagataaactatctgatggagtcctgtttcccagttcatagacagcagttttcttgatgaaacctcacttggtggaatgcaaggaaattcccttgagtcattttttaataggagcactaaatccatttgtgaggcttccactctcatgacttaatcaactcccaaaggcctcatcttta

SEQ ID NO: 18507 - DNA, 460 bp, Homo sapiens
tatctgagaactcacaagttattctataggtaatacagtctgaagtaaattgggtgtaaatgcccaatccttgtctcattccaatttacgaagcccagcagaaaacatttgttaccctatatttttacaatacattcattgtgatgaggctccaagctttatgaacaggaaattgggaggagagagctaatatgatccagtgtgattttagtgtaacaactggagcctttgcaaaggaaggagccaacaggtctgacatgaaacattggggccacacatttttgcagtgggattaaggaatgggagaacttgtgcttttcagcattggaaagtcctccctgcaaacattccacatttaaagtaaaatatttcaagccttcagaaagaagctgcaaaggaaaattgaaatagctcaacaacttgactatattttctagattttaagtccatgacaataaat

SEQ ID NO: 18508 - DNA, 405 bp, Homo sapiens
gtaaatgacggctgtaagaaataccacaaaggcagtgtggtgcctggaaaacagccatccacccagaatagcaggaggtgactcagtttaattctagagaggacaaaaatccatcaggaatccctaaggaccccagaatttctgcatggccaaagggaaacctaagccaatgcagtaacctaaaggcatttgtaatttttgtcattatgacctggaacagacaccaccatgtatgtgttttaatccccacttactcaggaagttctaacatttcccccaaaacttaactgttaagtagtttcaaagctaaacctctgtgttcattgtggtggtcgtggtcatggttgttttttgtttgtttttgttttttcaatttagcaacttaaactgagtaagaattgctgg

SEQ ID NO: 18509 - DNA, 608 bp, Homo sapiens
ttgaatggaatttgaggaggcgcagagaggagaaaaacgctgttactcgaaagaggaagagtcacaggaggatgctgagtgaacgcagcgcccaggcagggtcatctggggacctggtgcgtgtgagaacatatttcttctcctggcgccctccaggctcactgtggctggagccggtgacctgaagctgcagggctctggtaggaacagaggcactgaaagctgcattcctctccgtttggacttaggagctgctagtagttctgatgaaattgacacacattaggaaaaggagtcgcttaaaaagcatctgagattacctaagataatttgttaaaagaccaatgcttacacctgattttcttccctttacattatacctctttgatattgtctcaaggaaaaaaaaatcagcatgtgtcactgactggcacttatttgccacaaaagattgttcccctgagcttcttgtatttatctgataatcactggcaacgtcctcctttctgtgatgttgtctcctcacctctgtctctgccatgaggagccatacaacgccttgagattgtcagccaaaagatgttcttgaaaagctgggttataaaaaa

SEQ ID NO: 18510 - DNA, 325 bp, Homo sapiens
aggatggtcacctaaaattagaatttctggataaaagggcatatgcatatttaagactagtgaatattgaccgggcagagtggctcacacctgtaatcccagcactttgggaggccaaggcgggtggatcacaaggtcaggagatcgagaccatcctggctaacacagtgaaaccccatctctactaaaaatataaaaaaattagccgggtgtggtggcggtcgcctgtagtcccagctgctcaggaggctgaggcaggagaatggcgtgaacccgggaggcggagcttgcagtgagccaatatagggccactgcactccggcct

SEQ ID NO: 18511 - DNA, 708 bp, Homo sapiens
gctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgagg

SEQ ID NO: 18512 - DNA, 404 bp, Homo sapiens
tgtgtcaaattattttacctccctttataaaaaacaaactgatttcttcaaaacacctaaaggtagcattgttagagatcattctggttgaagttgtaactaattagtagtgggtacagctgcatataataggaaacccaaacttagatggcttagggaaagtagaagtttatttgccctcacaagtggggagcaaggtagctagcgccacagatgattagggacccaggttaccatcctgtgttctgtccttgaggtgtgtgacttccattcataagtcaccttaagggaggatgtcaggcagatgggcagaaaagagtctccttctgggcctgtcagcttggttacggcaatgctggccacacctagttgcaggagcagctgacagaagtggtcttttgttc

SEQ ID NO: 18513 - DNA, 536 bp, Homo sapiens
cgactctccctgcatggacccagcattcatcctgtccattctgttggccagagggcatttttgttttgttggtttttatttttgcaaggacaggaggtgacactccagacagcattagtgtttcctcctaaaaaaaaaaaaagtatttttaaaaagggacgattgccgtcttcaatatccagttccttaacctttttcttagcattctagcccgtgagaagaagaaatgtgtgaaaattctggagctttcctctcccagggataactggaggccttgaggattgaaagagaaagcgtcggttttttgtccttgagatagtttgctgagaatgatggtttccagcttcatccatgtccctacaaaggacacgaactcatcatttttttatggctgcatagtattccatggtgtatatgtgccacattttcttaatccagtctatcattgttggacatttgggttggttccaagtctttgctattgtgaatagtgccgtaataaacatgtaccctaaaacttaaagtataataaaaag

SEQ ID NO: 18514 - DNA, 797 bp, Homo sapiens
tgtagggggaatcccaaattgtcagcaacccatcactcccaggcaaaatccaaactgctgggctgtccccttggactgatttgtgtgctggcttttggggacagctatcctctgcacagtggacaccaggctctgttaagctgacctctaatgtgccttgaggttggttaccttggtgacagaaactccatttgcaccagcttacattaaaaaaagaggagggagaatatggtcgagtgaccccaggagtgatggggagcactgacggagtttctccctgctctggatagcagatccgctggctcccagcttatgatccatgaagagaacgtcttccccttgggcttcaatttgaagaatcctgaagacgaccctgatggcctttcgcggtccacgtgccccttcttgcactaccgtgatggtcctatccacggacgccttctcttgggttctgtggttggatgcggaggaatcatcgatcctctgtagtggaagggaagggaggacacaccaagaccatgtggccccaagagccgtgagaggagcagaagcctgactggtgcctcttacatgtcactgcagcctcggggggggccaccaggaaaacacctgacatcctgttctctagtaatggtgtggctggaatcattcctgtaccaaataattcacccatttaaagtgtgcaatccaacaatgattggtatactcagagttctgcaactctcaccacaatcaattttggaacatttctatcatccctagcaataaatactatatcttttttttgtgtgtgtgag

SEQ ID NO: 18515 - DNA, 643 bp, Homo sapiens
ctccattgtctgcgtgacaaagtggacgtagaactcccccatttcctgcccagggcgggtgaggaccctgcacacacacggtgtgtttgtgagctgtgcagagtggggtctccctggcaatggccacagcctccaggggcgctgacacctcccgtctaactggtagacagtttctgcctcttcttgtttggggattggagagggaagtgcgtctggatgactactaagatgaggaggctgaggcctagtgctcctagcgggcttggtcaagagcaggaggcggaggtggtggaaggctgtttccctgcgcattctagcccgtgagaagaagaaatgtgtgaaaattctggagctttcctctcccagggataactggaggccttgaggattgaaagagaaagcgtcggttttttgtccttgagatagtttgctgagaatgatggtttccagcttcatccatgtccctacaaaggacacgaactcatcatttttttatggctgcatagtattccatggtgtatatgtgccacattttcttaatccagtctatcattgttggacatttgggttggttccaagtctttgctattgtgaatagtgccgtaataaacatgtaccctaaaacttaaagtataataaaaag

SEQ ID NO: 18516 - DNA, 459 bp, Homo sapiens
ctccattgtctgcgtgacaaagtggacgtagaactcccccatttcctgcccagggcgggtgaggaccctgcacacacacggtgtgtttgtgagctgtgcagagtggggtctccctggcaatggccacagcctccaggggcgctgacacctcccgtctaactggtagacagtttctgcctcttcttgtttggggattggagagggaagtgcgtctggatgactactaagatgaggaggctgaggcctagtgctcctagcgggcttggtcaagagcaggaggcggaggtggtggaaggctgtttccctgcgatcttccagaatctctgctgttcacttttggagagtccagttagcctgtgaaaatgtcgtccctaggggtgagaggactctgggcgggtctctccagtgccgagggagacaccagcctccggctttcaataaatgtagccacagattaca

SEQ ID NO: 18517 - DNA, 1106 bp, Homo sapiens
ctccattgtctgcgtgacaaagtggacgtagaactcccccatttcctgcccagggcgggtgaggaccctgcacacacacggtgtgtttgtgagctgtgcagagtggggtctccctggcaatggccacagcctccaggggcgctgacacctcccgtctaactggtagacagtttctgcctcttcttgtttggggattggagagggaagtgcgtctggatgactactaagatgaggaggctgaggcctagtgctcctagcgggcttggtcaagagcaggaggcggaggtggtggaaggctgtttccctgcggtgacagaaactccatttgcaccagcttacattaaaaaaagaggagggagaatatggtcgagtgaccccaggagtgatggggagcactgacggagtttctccctgctctggatagcagatccgctggctcccagcttatgatccatgaagagaacgtcttccccttgggcttcaatttgaagaatcctgaagacgaccctgatggcctttcgcggtccacgtgccccttcttgcactaccgtgatggtcctatccacggacgccttctcttgggttctgtggttggatgcggaggaatcatcgatcctctgtagtggaagggaagggaggacacaccaagaccatgtggccccaagagccgtgagaggagcagaagcctgactggtgcctcttacatgtcactgcagcctcggggggggccaccaggaaaacacctgacatcctgttctctagtaatggtgtggctggaatcattcctgtaccaaataattcacccatttaaagtgtgcaatccaacaacgaggctccgtctcaaaaacaaacaaacaaacaaacaaacaaagttaaaagaaaccttctcttagacagtagtgatggcttcatttaaattagttgaggactagaaagaggcactgatttatcttcgctgtgaaaggtcctggccacgtgtaatgaatgggccctgtgagtgtgtgtgcatgtatgtgtgtgtacgtgcgtgtggctccctgagagtgtgtgtgtccacactgctgggttcctactcccgagctgccctgatagcatttggggtgggg

SEQ ID NO: 18518 - DNA, 560 bp, Homo sapiens
caatcagagcggtgtgatgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcatt

SEQ ID NO: 18519 - DNA, 3377 bp, Homo sapiens
acacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgcttataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacccatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaaaagttcagggtgtttggaattttacacctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggttatatgtcttaagtggattt

SEQ ID NO: 18520 - DNA, 4695 bp, Homo sapiens
  misc_feature (2791)..(2791): n is a, c, g, or t
agcttccttcacagggggaagaaccaacaacgcagagaccgtgggaaagagcccagcctatcgaaggtgctcaatgaacaggagccgcgctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattccctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattganacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacaggg

SEQ ID NO: 18521 - DNA, 520 bp, Homo sapiens
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggct

SEQ ID NO: 18522 - DNA, 4716 bp, Homo sapiens
  misc_feature (2812)..(2812): n is a, c, g, or t
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattccctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattganacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacaggg

SEQ ID NO: 18523 - DNA, 4354 bp, Homo sapiens
  misc_feature (2450)..(2450): n is a, c, g, or t
ctaggggagggttcagtgagagatgaaagaagcttcccgaaaaggcttcagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattccctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattganacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacaggg

SEQ ID NO: 18524 - DNA, 1050 bp, Homo sapiens
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattttggaaagcaactt

SEQ ID NO: 18525 - DNA, 367 bp, Homo sapiens
ttttcttctttttaaaaatgatgaatattattggagttctttttatctattgagatcatggcataagtttcttaaggtggagaattacactaaaagattttctaatattaagccatccttgcatttctgggaaaaatccattttgtttatgtgacattttgtacacatcattgaatttcctgattttttgcgtagcatttttgcttccatgttaacaagcaagattctgctatgatttttgtattcatactttatcagattggacatcaaaattatgctaaattcattaaatgagtctctgtttacataaaatggtgtctaagactggaattacttgttttacaaatgtttgatagagcttactggc

SEQ ID NO: 18526 - DNA, 249 bp, Homo sapiens
ctgtacccagtcttcatctctattttccattgccttcactaggctttcatcatgctagccttcttttcatttcatcaatatgtcttacggcattggcacttgctcttctctctgcctgaaagccttcttccagatctttgagtaggggttggaggcggttgaggagttcttgtaagtaatgctggagttccaaggtatctcctcactgaggctttgcctatccagtttaattcagtgccccctactgcc

SEQ ID NO: 18527 - DNA, 1205 bp, Homo sapiens
aacacattgacacacagagaggaacaacagacatgggggcctactggagggtgggcggaaggagggagaggatcaggaaaaataactaatgagtactaggcttaatacctgggtgatgaaataatccgtacaacaaatttctattatatgttacctatataacaaacctgtacatgtacccctgaacttaaaaggtaaagaagaaaactacaaaacattgctgaaataaattaaggaagacataaataaatataaggacatcccgtgttcatgaatttcaggctttaatattgttaagatgacaatatcctaccaagcaatctacagattcagtgcaatccctatcaaaattccaacagcatttttgtagaaaatctattcgaatattcatatggactatcagcagacctcaagtagccaaaaaattttgaaaaggaagagcaaatatgtaggactcacaattcctgatttcaaatcttaatataaatctacagcaattaaaacagtagggtactagtataaggagagagatagagatcaatggcatagaatagagggcccacaaataagaactcttacatatatggtgaagtgagttttgtttttcgtttttgtttttgttttttgtttttgagatggaatcttgctctgccgtccagcctggagtgcagtggcgtgatctcggctcactgcaagctctgcctcctgggttccgccattctcctgcctcagcctcccaagcagctgggactacaggtgcccgccaccacgcccagctaattttttgtatttttagtagagacggggtttcaccgtgttagccaggatggtctcgatctcctgaccttgtgatccacccgccttggcctcccaaagtgctgggattacaggcttgagccaccatgcccggccgactgaaactcttaagagccaaaactataaaaccattagatgaaaatataggggaatgtcttgatgacactgcgtttggcagtgatttcttggatatgacaccaaaagcacaggcaacaaaggaaaaaaatagttaagttgaactctatcaaaatttggaagtttcctgcatcaaagaacactgtcaaaagagtgaaaagtcaacccatacagtgtgaaaagattttcaaattgtatatctgctaatggattactatccagaatatatagggaattcctataattcaatgtca

SEQ ID NO: 18528 - DNA, 361 bp, Homo sapiens
gatattaaatcggtaataaaaacctcccaaagtgctgggattacaggcttgagccaccatgcccggccgactgaaactcttaagagccaaaactataaaaccattagatgaaaatataggggaatgtcttgatgacactgcgtttggcagtgatttcttggatatgacaccaaaagcacaggcaacaaaggaaaaaaatagttaagttgaactctatcaaaatttggaagtttcctgcatcaaagaacactgtcaaaagagtgaaaagtcaacccatacagtgtgaaaagattttcaaattgtatatctgctaatggattactatccagaatatatagggaattcctataattcaatgtca

SEQ ID NO: 18529 - DNA, 445 bp, Homo sapiens
gtgaggcgtgtccttacatttaaaacagctgagttaggaattatctccacagcctcgtgatcgtgaagggatgtgaagcagcactcaggataacgaagagtgcttgtgctgctcaccagtcggtaccaccatggcatacatggcaattgggacaatggagtttacaatttcagacaaaaactggaaaattacttgaaaacgagaaatgcattatttgcagatattctgctaactccagcatgaaccacagtgcactcagatagggtcccataagtgccctggctctgcgtgtgtgctctatcttgccttgccttggcttctctcgtaaagagcaggggccactttactctcttcctggccccatctagagggacttctgtttagatttattttagcagcttctatttagatttattttggcttgggtctccctttatctttctag

SEQ ID NO: 18530 - DNA, 2124 bp, Homo sapiens
  misc_feature (802)..(802): n is a, c, g, or t
agcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgattncctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatcca

SEQ ID NO: 18531 - DNA, 1040 bp, Homo sapiens
agcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaagga

SEQ ID NO: 18532 - DNA, 4635 bp, Homo sapiens
  misc_feature (437)..(437): n is a, c, g, or t
  misc_feature (2864)..(2864): n is a, c, g, or t
  misc_feature (3956)..(3956): n is a, c, g, or t
  misc_feature (4312)..(4312): n is a, c, g, or t
cactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcntgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaaggtcttcaagctgcacgccaaactggggaagcccattcccaccctcgagcctgcactggccacagagagcccccccggggcagaggccaagcccacgtcccccactggccccagcgtgtgtgcctcgagcaggccagcgctggccaagagacccgtggcctcgaaggccttatgcgaggggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcggaaggtcctggaggagcgcatgaggaagcagcggcacctggcggaggagcggctggagcagctgcggcgctggcacgcggagaggaggcggctggaggaggagccaccccaggacgtgccgccccacgcgccgcccgactgggcccagcctctgctcatgggcaggccggagtcacccgccagcgccccactccagcccgggcggcggccggcgtccagcgacgaccggcacgtcatgtgcaagcacgccaccatctaccccacggagcaggagctcctggccgtgcagagggccgtgtcccacgcagagcgggccctcaagctggtgtccgacacactggccgaggaggaccggggccgccgagaggaagagggtgacaagcgcagcagcgttgccccccagactcgggtcctgaaaggcgtcatgcgagtaggcatcctggcgaaaggcctcctcctgcgtggggacaggaacgtgcgcctcgctctgctctgctccgagaagcccacgcacagcctgctgcggaggatcgcccagcagctgccccggcagctccagatggtgaccgaggatgagtatgaggtctcctccgaccctgaagccaacattgtcatctcctcctgtgaggagcccaggatgcaggtcaccatatctgtcacctcacctctgatgcgggaggacccctccacagacccaggtgtggaggagcctcaggctgatgcaggtgatgtcctgagccccaagaagtgcctcgagtccctggccgccctccgtcatgccaggtggtttcaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagnccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccncagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggngacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtc

SEQ ID NO: 18533 - DNA, 2756 bp, Homo sapiens
  misc_feature (985)..(985): n is a, c, g, or t
  misc_feature (2077)..(2077): n is a, c, g, or t
  misc_feature (2433)..(2433): n is a, c, g, or t
gcggccgcctcagccccgtgggctcccagcgcagaccgggacgcctgccatcagcttcctggccgagtgctgacttgacaaccaacgctggctcctggctgatggggtcgggaagtgtggaaggagtgggtgctgccctgggggtggggacgctgccgtctcgtggccactcaacagcctggtggcaccgggctcatgtgggagtggactctgtttccacccgccaccttcgaggcccgccaggctccctattatcctccctggggttcacgctcacgacagagcccggcgccatgccgtgtggccacgtgagcccctgaaagctaaccgtgtgcttctcccccgaaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagnccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccncagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggngacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtc

SEQ ID NO: 18534 - DNA, 541 bp, Homo sapiens
  misc_feature (534)..(534): n is a, c, g, or t
cctcacccacattcgtaagtcataagtgagcttgcattaagaccatgaggttgtctgaaccagttggatgaaaagggaggacaataattctgaaattcattaagaaaacacaaggtggcagcagcggcccctcccgagcgccctcacctgtggccgaagcggggcggcaactgtgctcagtggaagaggctcactggccacacgtgggcttctctatgctcaggttttctgcaccaggctgacggatgcggggatccctccagaagtcatcatgggcatattctctaacatctcctccatccaccgcttccacgggcagttcctgctgccggagctgaagacgcggatcacggaggagtggtgagtaccatctgcgcatgcccatggggcccctcaagtgttctctagacctgggttcatgtgcctgagagcgaggcaagtgctgggggactgtctcatggtggctgggcgcctcccttctctgcacggtcctgggtccgatccagactccagcctgggcaacagagcaagacnctgtctc

SEQ ID NO: 18535 - DNA, 506 bp, Homo sapiens
atgttgtttagcattttcctaaggcagttttggacccatacaagtggggataaccgcaatgagtatccctccccagctccagaaacctcagcctggtgctgttcttatggcccctcagcccctagccccgacacacacacacacacacacgcacacacacacacacacacccccaattttctgtaatattttaaagcatatcccagacctctttttattctgctcagctacagtaatggtaagcttattttaggtagttttcttttaaacaggaaaaaaaaaaagaaagaaaaacacctgcaggcttcagtttccctgactggagaggttgagataaacatttctagtggcagttccagctctgacatcctggggaactcgatacatatctttgccttttcctaaagtcttcttaacagtggtttcggcacccataacaaagtgtctcaagggaggcacctcctccccagagaggaaatgctgggtgtggaccaagcttcaaaagc

SEQ ID NO: 18536 - DNA, 4942 bp, Homo sapiens
  misc_feature (2344)..(2344): n is a, c, g, or t
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctcnagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgccttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18537 - DNA, 4959 bp, Homo sapiens
  misc_feature (2361)..(2361): n is a, c, g, or t
tgcctgtgggtgccgcggaccttcggggcgggccagggaggcgggaccgctcctcagaaccccaggggcttcagtcctgggctgattggcgcgggaagcacagcccggccctccaggtccccaaggagaccccagcctcctgctgcccactgtgagcgacctccccggggctcctctggaagcggctccggcaagtatcgagtttgcctgtgcggagctgggggagcctccggctttcctgtttgctttgttaattattttcgtccccagaggaaggcgtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctcnagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgccttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18538 - DNA, 3298 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18539 - DNA, 3151 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18540 - DNA, 3267 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcgatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18541 - DNA, 1723 bp, Homo sapiens
aaggatcccatgtgagaagctcactggggcccctggggggacctgcgggcagctctcgttcctcacctgtgccatccctcttgcagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18542 - DNA, 3581 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccaaaaaaaaaaaaaaaaaacgaaccccgcagggactttatttccgggtgcgcgacaaggcgttatcaaggcccttgtcctgagtcgtgtccggccccgttcttgttccaagtgtgatctggcgcccctagggggacgtaaattgaaaccggtactataatgggcagacgccgggctaccagggagggaaggagacacaattgaatctgtgaaataatcatacgacacccctaatcgtctatcatatggcctcgtgtgacactacacgcacctgacgcaccgctca

SEQ ID NO: 18543 - DNA, 1875 bp, Homo sapiens
gagctcggtaccgggcagtacggatgtggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18544 - DNA, 1796 bp, Homo sapiens
gagttccaagcacagaagatgagcggtcatagctgtgtctgagcaggatgggaggcccgctgtccctgatggaccagctcatgtagcagccacgctgacctgagcctctgcacccctctccctgcagaactgtggggctgcaggctcacctctgttacctccttggggaaacacttctaagtcagaaaacatgaggctggagctaaaatgaccagcttgggtttgctttgttctttgttcttgccccttcaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18545 - DNA, 3221 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatgctgttcctgatgctagtggcacacagtgcttatctgcataaataaacactggccacca

SEQ ID NO: 18546 - DNA, 1425 bp, Homo sapiens
  misc_feature (1)..(1): n is a, c, g, or t
  misc_feature (35)..(35): n is a, c, g, or t
nctgtcaatcactggtcatttggttactttcactnttagaagcttcacctgaatccattctttcttctcttcctctgtcctctcctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18547 - DNA, 1335 bp, Homo sapiens
tgaggcttacgacccagggaccagtcacccatcccattttacaggtgaggaaactgaggctcagaaaggagagctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18548 - DNA, 1464 bp, Homo sapiens
tgaggcttacgacccagggaccagtcacccatcccattttacagctcgagcccagaaaactatcctctaagaccagacgtgacaaggagaagcagagctgtaagagctgtggtgagaccttcaactccatcaccaagaggaggcatcactgcaagctgtgtggggcgccatgctgaggggtgagaggtggtttctggttatgaatttgatttgcgtttccctgatggccagtgatggggcatcttcccctgtgcttggtggctcttcacactcttcctcccacgcacacaagactcctggactctggaccctccaggacagaagggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccacca

SEQ ID NO: 18549 - DNA, 1719 bp, Homo sapiens
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgctgttcctgatgctagtggcacacagtgcttatctgcataaataaacactggccacca

SEQ ID NO: 18550 - DNA, 1340 bp, Homo sapiens
  misc_feature (1333)..(1333): n is a, c, g, or t
ggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtggtgagtaccatctgcgcatgcccatggggcccctcaagtgttctctagacctgggttcatgtgcctgagagcgaggcaagtgctgggggactgtctcatggtggctgggcgcctcccttctctgcacggtcctgggtccgatccagactccagcctgggcaacagagcaagacnctgtctc

SEQ ID NO: 18551 - DNA, 337 bp, Homo sapiens
tgcggaacaaacaattttaaaacaaaacattttccattttctgttctttaaaagcctgtctgtacaagacccagctgaagctgaccagggcattcacacttcacacacaacccccagcccacctgctccaggctttcggtggggggcggagggtactgcctgggagctgcatttgggggttgcacctgagggtgctggtccatgcctggctagcactgactctggcttgtttctcccctacaggaagcccctggccagcctccacctgagcccagtgagctcagctttaaggatggagtcaggcagggggtcctcaacccctccaggacccattgct

SEQ ID NO: 18552 - DNA, 610 bp, Homo sapiens
attccactgtacagacagaccatgacaacttcatccattcatctgccgatggacacgggttgcttccagcttttggctattgtgaataacgctgctatggacatgaatgtacaaacatcccttcagatcctcctttcagttcttgtgggtacataccccgagtggaactgtggcatcatatggtaactctgtgtttaacattttgaggaaccaccctactgcttcccacagaggctgtaccagtttacttcccaccaacagtgcaaggattccaatttctccacatccgtgccaacactattttctttttgtcgctgttgtcattgtttgtctggaaaatagccatgctgaggggtgagaggtggtttctggttatgaatttgatttgcgtttccctgatggccagtgatggggcatcttcccctgtgcttggtggctcttcacactcttcctcccacgcacacaagactcctggactctggaccctccaggacagaagggtgggtaccagacgcccagcagggccagccttgctctctgccctcagacagggctcccctcaaggagaagctcttatccctcgccacacgccacactgtgttaagtctcc

SEQ ID NO: 18553 - DNA, 564 bp, Homo sapiens
caggcttcagtttccctgactggagaggttgagataaacatttctagtggcagttccagctctgacatcctggggaactcgatacatatctttgccttttcctaaagtcttcttaacagtggtttcggcacccataacaaagtgtctcaagggaggcacctcctccccagagaggaaatgctgggtgtggaccaagcttcaaaagcccaggaagttatttcatcaaatgatggggcctttccaggggttgcaggctattgtaacaggaaacggtaattagcaacttgccaaacgcagtcggggttttatgtactgtgatgaggcttacgacccagggaccagtcacccatcccattttacaggtgaggaaactgaggctcagaaaggagaggtgagtcatccagggttgcagggctgacaggaggcaggagactggggtctctccacctggcactgttcataatcagacagggaaaccaaggctggactgggcagccccaggctacacctgctccagcctccacaccaccctcctctgtaggcagttcaggcacaggagacaga

SEQ ID NO: 18554 - DNA, 352 bp, Homo sapiens
gatggaccagctcatgtagcagccacgctgacctgagcctctgcacccctctccctgcagaactgtggggctgcaggctcacctctgttacctccttggggaaacacttctaagtcagaaaacatgaggctggagctaaaatgaccagcttgggtttgctttgttctttgttcttgccccttcaggtgcaggatatcgtcaagccaaacacagcacatacattcatcataacgggaagaaaaaggtccctggagctgcagacgcggtatggaacgggctgtttctagtgaatgtctttgacctcatgtcttctttttctaaactggttaaccttgtaatatatttttattta

SEQ ID NO: 18555 - DNA, 351 bp, Homo sapiens
caggcgcgtccctcctgtgggtagcatcctcccatgcccctttatagtcctcactgttgtgttgctgtgtccagatcatccaggccaccatcgagaagcacaaacagaacagcgaaaccttcaaggcttttggtggcgcctttagccaggatgaggaccccagcctctctccagacatgcctgtgagtcagtggcccggggtgcagagagacctccaggggacgggctacctgtggagagcagaaggcactggcgtctgggtgggcagcttgacctccaggctttcctcctgctacaccagggaccaggacagcgggcactcccttgtgttaaaataaaaacttaagacaa

SEQ ID NO: 18556 - DNA, 1377 bp, Homo sapiens
tacaaacatatgatgacaggtaattgatcaaaccaactcaagaaacatgagaatcctgagctgtcagtgggggaagctgaagactaacctgtatttatacttcagaattttccagagactcccaaattgatagtatcagagccctctggactttaaaaagcagtgaaaaacaccgcattcctttggcacaggatgaagaccagctcagctcttcagttgttgatcattgtctattgttctccaaacagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgat

SEQ ID NO: 18557 - DNA, 1430 bp, Homo sapiens
tacaaacatatgatgacaggtaattgatcaaaccaactcaagaaacatgagaatcctgagctgtcagtgggggaagctgaagactaacctgtatttatacttcagaattttccagagactcccaaattgatagtatcagagccctctggactttaaaaagcagtgaaaaacaccgcattcctttggcacaggatgaagaccagctcagctcttcagttgttgatcattgtctattgttctccaaacagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgatattaaaaaaaaaattaaataaaaaataaagagtactacaaagttgtaaaatta

SEQ ID NO: 18558 - DNA, 1169 bp, Homo sapiens
agagagagagagagaaaaaaaaggtcaggtaggaagaagaaaaatagactttctgtgactgtatactcttgaaatctcccgcaggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgatattaaaaaaaaaattaaataaaaaataaagagtactacaaagttgtaaaatta

SEQ ID NO: 18559 - DNA, 1055 bp, Homo sapiens
tgtttacatactaattgatcacaaccagtctacagatttctgggttccttctccactcccactgcttcacttgatgtaggccttataaaaaaaaaaaaaaaaaaagaaaaaaagaaagatgtgtgctgcgccggactcagtgggcactgtggcaaggatttgtaaaagacacgctggcggttgggggtgagcggtggagcccctcgctgtccgtaatgtgatcatctttgcgtgtccctcgtgtgtttcgcttaggactcgccctggcgtgcctgggtcgtgcctctgggcttcgcgcgtcctttttacaagggcccgcggtgggcagcacccttgtttggcaagagacccatgctgggtgtacggcgcgtggcttggacggggtccttacagagtggctacccatagtggagtcccagttgtctcatgaggataccggcccctggtgggggcagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgatattaaaaaaaaaattaaataaaaaataaagagtactacaaagttgtaaaatta

SEQ ID NO: 18560 - DNA, 176 bp, Homo sapiens
catttataccagtttcagaagcttacaagtgcacaaaaatgtttcctgccgcccccaccaagatggaacagggacaagaagaactgatctgcatcatcctctagattctgtgtgcgcttcctgatccatgcctccaaatgacaagggttacaggcatgcagcaatgaatgtaggca

SEQ ID NO: 18561 - DNA, 228 bp, Homo sapiens
gctaaatggcctttggattgagtctcagcagtcacctactatagtagtcaagctgcataaacttagaattgatttctgtctgggtgcacattaggagggtaaaaataaaaccaacctcaacaaagctgagttggctaataacattcagtgcttggttttatgtggagcgcttcatagcactgctttgtattgtgatagaaaagggtgcagggccacctttgcctcttt

SEQ ID NO: 18562 - DNA, 654 bp, Homo sapiens
gagatagggtctgtctctattgcttaggctggagtgcagtggcacaaccatggcttactgcaaccccaacctcccaggctcaagcaatcctcttgccttagcctcctgagtgactggaactacaggtgcaaatggccatgcctggctaatttttgtattttttatgtagataggctctcactacattgcccaggctggtcttgaactcctgggctcaagcaatcctcctgccttggcctccagaactgttgggattacaagcatgagccaacacacctggccagcatatttttaataaatagcagtctgtgttcccactgcagacaactgaaccagagtttctaaggatggggcaagggcttgggtattttgtaaccatgttgtggttatgcttatatgcagcccaggttgaaaagcatgacgtagttcttgcacatcaaagatttttattttgatttttttctttttgtattcttttcaacattgtattaacatacagtgcacatctaagatttaaagatcttctgagacctgttaccttaaacttttgctccatttagtaaagctccttcttccagccagcttgtttcagaaactacacaaatcatgaattagaacaaaaacatgtatacaaaacctttgattgttagttgg

SEQ ID NO: 18563 - DNA, 321 bp, Homo sapiens
ctaaattgtggttcacatttatgctaaaaattgttccttatctgaaattcccaatgttaaataaggatcttatatttttatttgctaaatccaacaacactacattgtgttttaaagtgaattcggaaagaagctttggtggttttacattgcagtctttctcactgttttagcattagtcctatacacaaaattttccaactatatgtatttatggtgctgtagagagtctactgtaactctaattctaatttttgaaacagttagtgctcaaataaagatcgataactcctctggccatccagtagcacactgacagaa

SEQ ID NO: 18564 - DNA, 493 bp, Homo sapiens
gaaaagtggcctctcttccggaatgacacatactgacttttgaagaagcaaaaggatacctgctggccagtcatatcagccaaaaaactctggtgagcagtgagttggcagatgttgcaactggaagactgtggcatcaacagagccccaaagcaataatctctctttctcttcgcccccactaatccagcaatcaaataatcacttttaagcatttactgtgcaccaccatataacataaaatgtgatgaatagctaggtatatatatgacaacctctaaattctcaaaatattataataaattaagaaagcaagagttgtgcatgtaaaaagacaattaactacataggggaggaggcagtgaacacatttagtgcatctcccctgttaccggtcactgtgtgagggtgctgtacaagtactaattttatcttaatccccaccaaatcccggggaggcatttctatccttgttctgtggatgatgtgggag

SEQ ID NO: 18565 - DNA, 313 bp, Homo sapiens
gcagatgtttatcagcattgattcagtggctcagtggggtcaaggcctttctcttctgataggggtgtcacagccgtgatcaacgcactcctatcaaggcaggaataatgtggaaggatgatggcagaacatatctacccttctttgaagaaagtgaaagctttcccagaaatcccttcgttagccattaggtcccattagctacggctagatgatggggccaccctagtttcaagggagcctaggaaagcagggaacagaattgtcccatttacttacatgcattgtaatccaagtcctgggacttccccaa

SEQ ID NO: 18566 - DNA, 400 bp, Homo sapiens
tcaaatggtaggtgtcccccttctaacccccgcaacattggtacattgtgtctctcccattctgttctcctgcatttggtttgggagtctcaggtacagactatgacctctatcctttttgaatttcatcctgtatgttgcaccagatttcagcagaacaaaagccacgagccacttgtcccagtgacacgccagccacacatttctaaatacatcctctgtatcttctgagaagttctccttctggaaagatttacactttaaacaaagaggcctaagagatgcccattttatagataaggaaccaagcccccggggtgaagtacctgcccagggcatgggggcctttgcagcctaaccccagatcagtgagctttgctgtaccccccaaaacccctgg

SEQ ID NO: 18567 - DNA, 512 bp, Homo sapiens
gccgttctcatgatagtgaataagtctcatgagatctgatggttttataaggggcagttcacctgcacatgcactcttgcctgccactatgtaagacatgcctttgctcctccttgaccttctgccatgattgtcaggcctccccagccttgtggaactgttgagtccattaaacctctttttctttataaattacccagtcctgggtatgtctttattagcagtgtgggaacagactaatacagatgtcttgcagtagtttgcaaagtgtggacccccaaacaacaatataagcatcacaagctgtttgtctttcctgtggctgttgttagaaattaccacaaatttagtggcttaaaacaccaatttaggctgggcatggtggtgcactcctgtagtcccagctcctcaggggagctgaggtgggaggatcgcttgagccggggaattcgtgaaccgagactgcactactgcactccagcctgggtgacatagcaagaccctgtctcaaa

SEQ ID NO: 18568 - DNA, 440 bp, Homo sapiens
cacgagcaactcctctgtagtgtcagttaaggtatgcgtgaaacccaaacaggataaacccaaaagaatccacatctacatatatcataatcaaacttttgaaaaccaaagacaaaaaaagtcttgtgtgcagtgaaaaagatataacacctaacttacaggggaagaacaaatgatattggatttttcatcaggaactacagaggccagaaaatgaaaaggcagcatttttcaagtgctgaaagataagtattgtctaccaagaattccatatcaatcagaaatacccttcaggatgatgggaaaataaagacattctcaagtgaaagaaaactaaaagaatccgttcccagcagaccagtcctaaaagagtagctaaaggatgttcttaccacagaaaggaaataatgaaagagggaatccagaaacatcaggaagga

SEQ ID NO: 18569 - DNA, 544 bp, Homo sapiens
tttttttatgttttaatttcctcatcagccatttaactttatgccatatggtgatggcagagctgtccccacttctgtgagaagaccctagtggttccatgaacatcttttgagaaagcagacccactgagcgtttgcttagaagagcagaagggaggctggggaggatgcagtagccatctccttttcatcttcatctcctagaccttaactcatctgctaccatttgactggcattgtcatctagctcctctggcgtgcacacacacatgcataggcagtgtcagtctgttggcagcacctcccaggacagacttgcgatcccacgggctctgcagtcccaaattgctagggctctcttttgagttaagtgtcaggctggccatggaaacctgggattgggccctggctgccttagtggctttgagtaagagggccgggcatttaatatttgttgaagtgactgagctctcagtgcgctcatttatctgtctgaatagtggatagtaatacttctcagctccatggagataatggtaatgat

SEQ ID NO: 18570 - DNA, 366 bp, Homo sapiens
aggcaaaggacacaggataggcagtaggaaaccaaaaatgtccagatcataagaggcaacttccaaaataagaaagctgaatttcaacacatgaactcgtgagaacagcaagagacaaacaagatcatgagtggtacaaagcacaaaaaggtgtggttgcctgaaaaaatccaaacttaatcttcttctgtgtttgctgaaagctaattttgctctccctcttccacatcacaactgagtccaattttgcataccttggtttaaagcttacacaataagcacttttctcaaatggtaagccagcacacacattttggattgtagagcatgaacagaggtttagtgcagctttgagtttctttaagg

SEQ ID NO: 18571 - DNA, 467 bp, Homo sapiens
gtgttgctcaggctggtctcgaactcctagcctcaagtgatcctcccaactcagcctcccaaagcagtgaaattataggagtgagctaccacgcccagccttgaggcttctttatattcttaaaaattactgaggaccctaaagagattatatcttttaatacttagaatcagaaatttaaactgagaattgtaaaaatatttattaattcattttaaaagagcaagatatgttactgttagtactttttcataaaaaataactatattttccaaaacaaataaactaaaaatagtgaaaaggctggatgtggtggaatgtgcctataatcccagctactggggagactgagatcagaggatcaactgagcccaggagttcgagtccagcctcccaaagtgctgggattatgggattacaggcatgagtcaccacgcccagccagctgtttcaactcttaggggtga

SEQ ID NO: 18572 - DNA, 440 bp, Homo sapiens
gcctttctcactaagggacccctgtgctggcatggatgcatggcacctgttggcatcttcagcagaactctgggtgctgtgcaggaggcaaacttgggggacagtttaaatccctctcaattgtacagctgttcggcccgactgaactgcagtggtggctgatggaagcaaggagactgggctagaatggaaggaaccaaagagatctcattggaacagctttcaaatcttcatcttacattcacttttgggaacattaccccccttcttgccaaggattgacaactctttctcacttaaccacacaacatccttcctggaattattggggtgcgtatgatggcatggcatagtttggttagagatgctgtgtccagttagccttatgatagaatgactacactagaacttttttcaagaaataaaaacataaaaatatt

SEQ ID NO: 18573 - DNA, 721 bp, Homo sapiens
ttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttacaaataaat

SEQ ID NO: 18574 - DNA, 283 bp, Homo sapiens
atacagataaacacgggagaggctgggtcacggtgaggccggaaattattcatcagcaggagcttctgttctgggatgggcaccacggcgctgacattaactggccagaaggctgaatcaagacagaggaaatggaagaggaaggggtgtcttccccgtgatagcattcaccacctgtgctgagattgggacattcgagcctccgttgataagtggctctggagccagctcacctgggctcaccggggctcaaaccctggcttcccatccaccagtggggtgt

SEQ ID NO: 18575 - DNA, 744 bp, Homo sapiens
ttttagacagagtctcggctcactgcaacctctgcctcccgggttcaagcaattctactgcctcagcctcccaagtagctgggatccaacaccacgcctggcttattttttaatttttagtagagatggggtttcaccatgttggccatgctggtcttgaatcctgatctcagatgatctgcccacttcggtctcccaaactgctgcaattacaggtatgagccactgcacctagccacatattttcacctggcatataagtaaaactggctaattagcaactcccctagattttttgctgttctattttattgcaagaacagaaacatacttttcccctttgttgaaagatctccagtggcttcccatcttttataagggcctgctcctcactaccattctgccctcaacccctgctgctccttctcactccattcacaccaaccacactggtctccttactgttccctcaacacacaaagcatgctgctgtctcagggcctttgcacttgctatcctattttcatggaatgttcttcccctaactaaatgcatcgcatatctccctcctcttcattggggtctctgcttaaaagctaactactcagataagctttccctgaccacccccctaaaagaacaccccatcccacattgactctatgtttctctagtttgctctgtcttcacagccacttcttcccatctggcgtagtagacacttatttgtctatttattgctaa

SEQ ID NO: 18576 - DNA, 1131 bp, Homo sapiens
gccagacatggtatattaaagcaattctagccaatctcacactcaaaaattacccaggtaactccaaaaagtacctccatacagtttgttaaagctggaaggaagccagcttagttaccataatcctttcattttacagagaagctaaccaaggctcagagggagtaaagtgacatgcccaacgtcacacaactcatagtgtcttacgccatttgtctcttatttggcattcacctcctgcttagggacacatatatgggtgtctaaccaataaaagatgtttgcttgtagaataaaggtgaacagttctggatggaatgtatattttctttcttttttttttgagacagtctcactctgtcacctaggctggagggcagtggtgcaacctcgactcactataacctccacctcctggggtcaagccattcccctacttcagcctccccagtagctgggactacaggcacacgccaccacgcgcctggcttattttttaatttttagtagagatggggtttcaccatgttggccatgctggtcttgaatcctgatctcagatgatctgcccacttcggtctcccaaactgctgcaattacaggtatgagccactgcacctagccacatattttcacctggcatataagtaaaactggctaattagcaactcccctagattttttgctgttctattttattgcaagaacagaaacatacttttcccctttgttgaaagatctccagtggcttcccatcttttataagggcctgctcctcactaccattctgccctcaacccctgctgctccttctcactccattcacaccaaccacactggtctccttactgttccctcaacacacaaagcatgctgctgtctcagggcctttgcacttgctatcctattttcatggaatgttcttcccctaactaaatgcatcgcatatctccctcctcttcattggggtctctgcttaaaagctaactactcagataagctttccctgaccacccccctaaaagaacaccccatcccacattgactctatgtttctctagtttgctctgtcttcacagccacttcttcccatctggcgtagtagacacttatttgtctatttattgctaa

SEQ ID NO: 18577 - DNA, 479 bp, Homo sapiens
gccagacatggtatattaaagcaattctagccaatctcacactcaaaaattacccaggtaactccaaaaagtacctccatacagtttgttaaagctggaaggaagccagcttagttaccataatcctttcattttacagagaagctaaccaaggctcagagggagtaaagtgacatgcccaacgtcacacaactcatagtgtcttacgccatttgtctcttatttggcattcacctcctgcttagggacacatatatgggtgtctaaccaataaaagatgtttgcttgtagaataaaggtgaacagttctggatggaatgtatattttctttcttttttttttgagacagtctcaccactgcactccagcctgggcaacaaagcaagaccctgtctcttgcaacaacaaaaaaaattaaaaaccacgtctagccgtgggtaaaacaacaacaaaaacaaaaaaaacacaacaacaaaac

SEQ ID NO: 18578 - DNA, 1119 bp, Homo sapiens
taaaactaccatcattcacagatgacatgcttgtgtatgcagaaaattctaaggaagctacagattaaaattattaagagattagcaaagtcagtgtacaatatcaacatcaaaagaccagttatatttctatataccatcaacaagcccttagaaaatgaaatttaaaccaatatttaatttatagtagtatacacaattaccttgaactaaatgtaataatagacgtacaaaacctcaagcaaaagttatgaagctttgttgacaatgtcaagtgtttgtgaggatgtggagcaacaggaactctcaaacattgatggtggaagtgggaattggtacaactttgatatacagtttggtggtatctagtgaagttgaaaatatacacaatctatgagccagcaattcctctcctacatatataccttgtgtgtgcacatatgtaccaggagacattaaaaacatgttcttagcaacatttttcataattgtccccaactggaaacagtccaaatgtccaccgacagtaaaaggataatttcttgtaaagtcgtagaatggaaagctgtaacacaatactgagaatgatgaaccgatgccgcatgcaaccaggttgaatctcagaagcataattgtaagggcaatgagctggatatagaaggatatatgcattatagttctatttatataaagctccagaaacagtagtgtttgggcatctatatttgagtggtaaagctataaaggaaagtaagaaagcaacagctaaaactgtcatgagagtgttttgttttgttttggagagaggaaagaggttgtgattgggcaaggacttatgggaatttctggagttctgatctgttctgtttcttgatctttatggtgatttgctttataataatttgttaagctgtaaatttatattttatgcactttcctctgctccccccgccccccgcttaaagagtgttttagaatgtggaaattttaagataagatctatctcagggcttgttgtaagaatgaaatgaagtataaagccatgtagagcttgtagaatatgcctggcactttgtaagaccttaataaatgttaactatctaaacacaaaaaaaaatt

SEQ ID NO: 18579 - DNA, 423 bp, Homo sapiens
attttttaaaactttttaaaaatacacacaaaaagcagtttgtggtctaatttctttttccttgctcagcctcatcttttagcacctgtttatacacatatcacctctattcttgtaacaaaaataggtagaactggccagacacagtggctcatgcctgtaatcccagcactttgggagaccaagatgggaggctcaatagtttgagcccaggaattcaagaccagccagggcaacacaccagaccctatccctactaaaaattaaaaattagccaggcatgctgcacaccagtagttctaggaacttaggaggctgaggcaggaggatcatttgagcccaggagttcaaggctgcaattagtgatgatcatgccactgtactcccacttaggtgacaaaacgagactttgtctaagtaaaa

SEQ ID NO: 18580 - DNA, 924 bp, Homo sapiens
tagctaggcgagtatggtatcacagaagctaagagaggagtgtgtttcagggagggggagagagatttaacagtgttggatgctggtgggaaatagccaagtaatttaataacatggagatcattggtgatcttattggcatggtgagcactgctgcatatgagccaaggaggtacaagcagatgagagagggagtgtataatgttctctagagggcaggagggctggaatctggagcactgatgaggagagtgagggaaggtttgagcgttagataaaaggaagggcaatttcatataatgtgtcttttaaaacattaaaaatgtttgcttacagtcacagattgtcacaatgacatcaatcatttgtcccctgggaattaatctataggtacctggttttgcagaacatattttatgtgattcacatgtctatatgcagtcttggcacacttgttttccttttgtgattattatcattaagacaagtgatgtattcaatcaaataacgttctagattcagttgagcaatgaactttgctctcattcttttttaaggcagctcaactgtacatttgtattagctctttttcaacacacatatttagccctgggttaaatatcagaaattttcatatttctggtaaacctctggccagtcatttgaccccaaggggaaatcagttctatctatatatagtagatttttaaaaaaaggaatattgtatattattgaaaatgctggtcattctaaatcgccacttttcacttagtatagtgtcagctgaaaaccgtaagaagagaaacaccttccatctgatttaaaatatgttttagggccaggtgcagtggctcatgcctgtaatcccagcaacttgggaagctgaggcaggaagactgcttgaagccacgagtttgagatcag

SEQ ID NO: 18581 - DNA, 767 bp, Homo sapiens
tagctaggcgagtatggtatcacagaagctaagagaggagtgtgtttcagggagggggagagagatttaacagtgttggatgctggtgggaaatagccaagtaatttaataacatggagatcattggtgatcttattggcatggtgagcactgctgcatatgagccaaggaggtacaagcagatgagagagggagtgtataatgttctctagagggcaggagggctggaatctggagcactgatgaggagagtgagggaaggtttgagcgttagataaaaggaagggcaatttcatataatgtgtcttttaaaacattaaaaatgtttgcttacagtcacagattgtcacaatgacatcaatcatttgtcccctgggaattaatctataggtacctggttttgcagaacatattttatgtgattcacatgtctatatgcagtcttggcacacttgttttccttttgtgattattatcattaagacaagtgatgtattcaatcaaataacgttctagattcagttgagcaatgaactttgctctcattcttttttaaggcagctcaactgtacatttgtattagctctttttcaacacacatatttagccctgggtgaccctgcctcaaaaaaaaaaaaaaaaaaaaaattaaaggccaggcatggtggctcacacctgttgagaagttgaggtggaatgatcccttgagcccaggaactcaagaccagcctgggtaacatagagtccctgtatctatcaaaaaaaaa

SEQ ID NO: 18582 - DNA, 381 bp, Homo sapiens
catgccaccgcactctagtctgggcaacagagtgagaccctgtctctaaaaaaattaagtagatagataataaataatacatttttataattatctattttataaccaggcatggtggcgtgtgactgtagtcccagctactcaggaggctgaggtgggaggatcacctgagcctgagaggttgaggctgcaatgggccatggtcatgccactgcactccagcctgggtgaccctgcctcaaaaaaaaaaaaaaaaaaaaaattaaaggccaggcatggtggctcacacctgttgagaagttgaggtggaatgatcccttgagcccaggaactcaagaccagcctgggtaacatagagtccctgtatctatcaaaaaaaaa

SEQ ID NO: 18583 - DNA, 501 bp, Homo sapiens
ctgaaaccctggggaaaaagttgggagtgtcaaaggtctcaggccatcaacttgttgccaatcaccagctctgtccagttccccaggactgcctgggctctgttacatgaggtctcatcctaggaacgaccattggtacccacctggctggcagagggctttctgctttctaacctcctctcgcagggttcaggctatctctggccacgatcttcccttcttctgctgagtcaaagcaaatatctgaggcattctgagggacacttagaactgaggagcaattaagaaatgccctccaggagggactggcctccatgttacatggtcatcctacaagtcctaatggaggccctgagaatggcattgccttaatggccatagtaggaaaaatgagcaatgttgcctgatcgctgcaattgaatatcaaagatgttaactgagaggcacatgtatacacactgccaaacattaaaccatcttcctacacattgcagggcatga

SEQ ID NO: 18584 - DNA, 470 bp, Homo sapiens
atgctcttacttctatgaaccttatttttcttacctttaaaactgaatgaaatttcctttcttagaaggcttatagactgagtcttgtctttagttcagcggttatcttctactggtttggaaaagagatatttgaatatctgtatcatcttactaggctgcagacttctagagagcaaagactagatcataaatacctacttgcccttcatacctcccacatacataatccatgcatcatgaatacttgttaacttaaatgcatgacatgtaaaagaaatgcttgtaaaaaaaataggcgatttgacggcatcttcttatattggactatagtctcttgaatgttttcccatatatttctttttcttggggtctttccagctagttcttaggaaagtgaaaagctaataatattgattcccctcctcacccctgggactttgcaagacagaaccaaaaaaataaaaaat

SEQ ID NO: 18585 - DNA, 919 bp, Homo sapiens
ttgggaagcagcgatttctccttagtcacagtcagagagggtgatgcgacacactgggcttcactgtgctcgtgaagcggagccagggtgaaaggatcatatggcctaaccctaaccctaatgggagtaacttcacctgcgtcccacaggccccgcaagagtgacgctgccaggcaggcgccgccctgttcggttcctgctgctgtcgctcctcgctccccaccacctccagagctccggtgggtcaccatggaaagggaagccgctgcctgcaaggccagcagacacagaggtcaccctccaattttttcgggtaacattctgtaaggacagaacaccaggaggctactcctaccaccaggagcatgtcaggtaaacatccagagagatgaaggaagaaaaaattttattttagccaccaagaaatacaagccgttctaaagattatacttaaaagaaaaaaaaaacaaaaaaaggaaggaaaaaggggaccgatgatcttgcaatcacggaagttgtagagagctggctgcctagagacactgtgcccttccctcctccctcttttcctcttatcaaccagaggcagagactaagaatgccttcaagcaactaaagcctaaaataaaaaagaaagaaaagaggaagagggagagggagggagagagagagagagagagagagagagagagagagagagagagactgttgctttatgctattacaagtccaagaaaaaaaaaaaaagagatgaactttaaactttaaatacttagcagctgccaggtctagcaaacatgctagccctagatcacttactgatttataaacaaacccctagatacagagggggaaaaaggtaattaaataaaagttatatataatattttaacataaatatatgttgataaatggtgta

SEQ ID NO: 18586 - DNA, 2870 bp, Homo sapiens
  misc_feature (1232)..(1232): n is a, c, g, or t
cgcccgggcaggtcaaacacgcagccccctcccgctggagcgacaactggccagcatactctaggctgttgtccctttaaaacttgaatccaagggggtaatgatttatcaaacttgtattatcaagaaaatgtcaaaccaagggcaccttgctttgcactgacgcaaacccggcctttcccaaggagatatagaaagcgcctctcctgcctgagccaaacccagtcttgtcaatagcgggtttcaccctccaccagttcagtctgttgcctgtgtcagacatggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgttgcactgtaagatcccttctctgcgaggcccggagggggatgcgaacgtgagtgtgggcaagggcaccctggagcggaacaatacccctgttgtgggctgggtgaacatgagccagagcaccgtggtgctgggcacggatggaatcacgtccgtgctcccgggcagcgtggccaccgttgccacccaggaggacgagcaaggggatgagaataaggcccgagggaactggtccagcaaactggacttcatcctgtccatggtggggtacgcagtggggctgggcaatgtctggaggtttccctacctggccttccagaacgggggaggtgctttcctcatcccttacctgatgatgctggctctggctggattacccatcttcttcttggaggtgtcgctgggccagtttgccagccagggaccagtgtctgtgtggaaggccatcccagctctacaaggctgtggcatcgcgatgctgatcatctctgtcctaatagccatatactacaatgtgattatttgctatacacttttctacctgtttgcctcctttgtgtctgtactaccctggggctcctgcaacaacccttggaatacnccagaatgcaaagataaaaccaaacttttattagattcctgtgttatcagtgaccatcccaaaatacagatcaagaactcgactttctgcatgaccgcttatcccaacgtgacaatggttaatttcaccagccaggccaataagacatttgtcagtggaagtgaagagtacttcaagtactttgtgctgaagatttctgcagggattgaatatcctggcgagatcaggtggccactagctctctgcctcttcctggcttgggtcattgtgtatgcatcgttggctaaaggaatcaagacttcaggaaaagtggtgtacttcacggccacgttcccgtatgtcgtactcgtgatcctcctcatccgaggagtcaccctgcctggagctggagctgggatctggtacttcatcacacccaagtgggagaaactcacggatgccacggtgtggaaagatgctgccactcagattttcttctctttatctgctgcatggggaggcctgatcactctctcttcttacaacaaattccacaacaactgctacagggacactctaattgtcacctgcaccaacagtgccacaagcatctttgccggcttcgtcatcttctccgttatcggcttcatggccaatgaacgcaaagtcaacattgagaatgtggcagaccaagggccaggcattgcatttgtggtttacccggaagccttaaccaggctgcctctctctccgttctgggccatcatctttttcctgatgctcctcactcttggacttgacactatgtttgccaccatcgagaccatagtgacctccatctcagacgagtttcccaagtacctacgcacacacaagccagtgtttactctgggctgctgcatttgtttcttcatcatgggttttccaatgatcactcagggtggaatttacatgtttcagcttgtggacacctatgctgcctcctatgcccttgtcatcattgccatttttgagctcgtggggatctcttatgtgtatggcttgcaaagattctgtgaagatatagagatgatgattggattccagcctaacatcttctggaaagtctgctgggcatttgtaaccccaaccattttaacctttatcctttgcttcagcttttaccagtgggagcccatgacctatggctcttaccgctatcctaactggtccatggtgctcggatggctaatgctcgcctgttccgtcatctggatcccaattatgtttgtgataaaaatgcatctggcccctggaagatttattgagaggctgaagttggtgtgctcgccacagccggactggggcccattcttagctcaacaccgcggggagcgttacaagaacatgatcgaccccttgggaacctcttccttgggactcaaactgccagtgaaggatttggaactgggcactcagtgctagtccagtggtgtgggatggtccagacttgatcctgtttttcctctctgcctcctcctaatgttttccatagctctcctcccatttttcttcatctttcttcctacatcttggttcacatccacgcatgagagtgattatgtagaaaagtaggcatagtgtcgcatgctgcagtaaagagctacatagaccacctga

SEQ ID NO: 18587 - DNA, 1898 bp, Homo sapiens
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcc

SEQ ID NO: 18588 - DNA, 2593 bp, Homo sapiens
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattgaaaaaaaaaaaaaaaaaaaaaaaaaaaaaaaaaaaaaaaaaaagaacaaaaaaagaaagaaaacaaaaaaaaaaaaaaaaggggggggggcgccgcagcaaaacactcgccagggggggacccacattatgacagacccacgacttgttgtaggagcaagagggcgcccactagtagggggcatataaaacacgcagcggcgagggcagcgatataaaaacagggaccgtgaggggagggaaaaaggggtcaacagtggagggactacatggagggacagagccacaccacaatcgcgggggggggggggcacacatgaggggcggcacccaacacccaccgagcgagatataaacgcccccgaaggggcacaaatcacacaagagaggttaatgaggtgtggaacacacaacgcgatataagagcaggagcgacaaagaagtgcgcccaccagcaggaatcacaagaagaaaaaaccacgggg

SEQ ID NO: 18589 - DNA, 2125 bp, Homo sapiens
tgcaggctgtactggtccgaaggtcttatgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattgaaaaaaaaaaaaaaaaaaaaaaaaaaaaaaaaaaaaaaaaaaagaacaaaaaaagaaagaaaacaaaaaaaaaaaaaaaaggggggggggcgccgcagcaaaacactcgccagggggggacccacattatgacagacccacgacttgttgtaggagcaagagggcgcccactagtagggggcatataaaacacgcagcggcgagggcagcgatataaaaacagggaccgtgaggggagggaaaaaggggtcaacagtggagggactacatggagggacagagccacaccacaatcgcgggggggggggggcacacatgaggggcggcacccaacacccaccgagcgagatataaacgcccccgaaggggcacaaatcacacaagagaggttaatgaggtgtggaacacacaacgcgatataagagcaggagcgacaaagaagtgcgcccaccagcaggaatcacaagaagaaaaaaccacgggg

SEQ ID NO: 18590 - DNA, 253 bp, Homo sapiens
ctcctccaccagcagccgtcgaggtgttccagcggcctcccacgctggaggagttgtccccacccccaccgggtaaggaggtccaccctcttcttcccaaccgtggggtcgcttttctgcctcctgccactccccagcccacctctcttggatctgccccggccagcctcagtgaatgcctcctccaaggagcgcagcacaggggcgaaaggagacagaggaagtgaactaacataacttagcgcctgctgta

SEQ ID NO: 18591 - DNA, 396 bp, Homo sapiens
ggaagtgggaactggctatgccgggctctccctcccggttcccgtccgcccctcctccatttcctcttggggatgagggtggagggaggcccctcaccccaaatgtaagccctacctcccgctccctcgcaggacctcagcacgcagctgtcaagaacaggcaccctgtctcgaaagagcatcaaggcccctgccacacccgcctccgccaccttggggtgaggcctcgccgcgacgccaactagcctagccctgccccgcgcgaccctgaaactctcctcccccagcctcgccacccacccctggcgcccccgggtgctcaggccgtcatgctggatgcctggcgccaaacctccccctcggccacctgcccttcctgctcgcacccgacccctg

SEQ ID NO: 18592 - DNA, 682 bp, Homo sapiens
aagagctgcccctgccactggacctgcctcctcctccacccctggatggagatgaattggggctgcctccacccccaccaggatttgggcctgatgagcccagctgggtgcctgcctcatacttggagaaaggtacctgacttctgggactgaggggcaccggatcccacttcctctgttgccctgatccccattctcctccctctgcaaaggtgtgaatctatcccccgggccccccacacaatttttctgacgaactgacagaactggggagagggcagctggcctggtattaaatattaactaagctggggaggggtcctgaaggcttgcaagaaggcccccaagatggcccctagagtctagtacttgagaccgtgcatccccatggtggtggggggtgagggggagagggcaagaggcattatctcacggcaccctcttctcttgccctgcagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagc

SEQ ID NO: 18593 - DNA, 1919 bp, Homo sapiens
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggcctttctgcttttcccccaagacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcc

SEQ ID NO: 18594 - DNA, 2107 bp, Homo sapiens
tgcaggctgtactggtccgaaggtcttatgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgtcttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattgaaaaaaaaaaaaaaaaaaaaaaaaaaaaaaaaaaaaaaaaaaagaacaaaaaaagaaagaaaacaaaaaaaaaaaaaaaaggggggggggcgccgcagcaaaacactcgccagggggggacccacattatgacagacccacgacttgttgtaggagcaagagggcgcccactagtagggggcatataaaacacgcagcggcgagggcagcgatataaaaacagggaccgtgaggggagggaaaaaggggtcaacagtggagggactacatggagggacagagccacaccacaatcgcgggggggggggggcacacatgaggggcggcacccaacacccaccgagcgagatataaacgcccccgaaggggcacaaatcacacaagagaggttaatgaggtgtggaacacacaacgcgatataagagcaggagcgacaaagaagtgcgcccaccagcaggaatcacaagaagaaaaaaccacgggg

SEQ ID NO: 18595 - DNA, 515 bp, Homo sapiens
aaaagctcaaagaattgaacagctattggtgctaagttataattgtgttctataaaataaatgtgattcactattctttgtaattgctacctcctggtatgtataagataaagaaattgaattttacctattttctcacatactaatttggtgacgtatccttttaactgttggcaaatgttataggctctcttggcctgttttttattccattattttaacatcttttgcagttttctcacataagattgaaaactgaatctatgtgaaataagcaggtgtctatcagtaatgatatttaaaatatgtcacagctggattccctgttttgtaggagcatctgaaatcagccatagcggaacagatggaaatgccccatttgttggggtcaagaaggaaaagttcttacatagttttacacatttggctggtgattgattttgtgaaaagatatgttaaaatttgtttgttttttgagacggaggctcactgtgttgccctggctggagtgcagt

SEQ ID NO: 18596 - DNA, 290 bp, Homo sapiens
tatttttagtagagatagggtttcaccatgttggtcaagctggtcttgaactcctggggtcaagtgacttgcccacctcagcctcctaaagtgttgggattacaggcatgagccaccatgcccagcctctagagctatcttagccctattaatatagcatgatctttctgggatgttactaaatgccttgggtgttcagtgaggttcctctagtctgacttggtagagcttgattgtttcctgcttgtgagctctggaaattgactggcctgtggctccttggcaactac

SEQ ID NO: 18597 - DNA, 283 bp, Homo sapiens
aaatactcttctcagattatctcatttaaccatcatcaataactctataagataggccacttggaaatatgggaccattcaggaaaaagtctaaattcttgtttctgtttttaagaaattcagttttattacagttaacaccccaaatattataacatttttaacaaggtgttaccaagaaaggtatgctactgatgagttttaatgaacatataaaaattcattttaaattatacaaatgcaaggtattattctttttaaaaacttcatgttataaagcttt

SEQ ID NO: 18598 - DNA, 393 bp, Homo sapiens
aaaagtaatctgaaaaaagatgatgtggtagttaaaatgaatttgaatcatgtattctttttaccacagaatgatttcataaccttgagaaagtcactgacctcctatatgcctctattcttatctctttaaagtaaagctaatatcttcaccttattatctacttcagtaatgaaggtgtaaagactaataaccataaaaagcacatcaggctttctggaagtcaggctcagtataaatataaagtatttatgaagcagagcacagcacgaatttataaatctaaagacaaagtttttttaatgtatcttggaaaaaaaatacacaggagaaataaatcatctttgatattcatttttctgaaggtactcctgtgtccaccatattccctgc

SEQ ID NO: 18599 - DNA, 489 bp, Homo sapiens
gggcagtggcacgatctcggctcactgcatcctctacctcccaggttcaagcgattctcctgtctcagcctcccgggtggctgggactacaggtgcgtgccaccacacccagttaattttttttgtatttttacagagacagagtgtcaccattttggccaggctggtctagaactcctagccttaagggatccacccaccttggcctcccaaagtgctgggattacaggcgtgagccacagtgcccagcttagatttcttaatctgattatctgatgaacccaaagcaggcctcaaacaagtactaaacctacccattcattctagggagtcttggtaaatttttactaacatgacttggattgcacaggattagataactatgaaaaatcagacctgtaagtcagatcctgttgcctataaatctgatatttcaggtgactgtaacagtggaaaacaaatggcataaactgaacattgaagaatagg

SEQ ID NO: 18600 - DNA, 377 bp, Homo sapiens
gtgatagaagtgggtggccctgcagagagcacacaagggagagcagggctgggttggataagccaggccaggagacacagagaccatgctcatgggaagagtggacgtgcagtctgcactttcctttctttggatccactcttcccagcttgttagctcaagctaggagcacacagtgtgtctccagtccttcaccaagaggacaggagatcgagatgtggaggtggcccctgggcagataactgaggtgacaaaccatagaattggttccacatgtagaagaaagtctacaaatgtagccgatcttataatagcatgcagcaccctccagccgagccacacaagctccacctgcccctccagctccacctgccgtg

SEQ ID NO: 18601 - DNA, 479 bp, Homo sapiens
atattcttccagttgaaaggtaaccagaactggagactatattgtaaataagcttttagttaggtgtgaggtcccaagagccaatggtctagagccatttggtatgagtcctgaaaagcaccaagcttctttgaggtttgtctacattcaacttaggatacatgtggaattctctcacatctaaactgaatctttccttctcagggactcagtccatcctgcacatgccaaaggcttcttattcttcttatagtctgtaaaagtgctttcaccgatcagcttaggtcatctgtcccccaagatcttctgcacagagggacactcaaaccaataactatgtcttcttagaatcatttcggaatgactgataggaaaaaaaaattgccataaagaggccgaggcgggtggatcacaagatcaggagatcgagaccatcctggctaacacagtgaaaccccgtctctactaaaaaagataca

SEQ ID NO: 18602 - DNA, 333 bp, Homo sapiens
tcgctttgttgattgtttccttcgctgtgcagaagctttttcacttgatgtaattccatttgtctctttctgctttcgttgcctgtgcttttgagattttacccaaaaaatctttatccagaccaatgtcctgtagtgtttccccaatgttttcttccagttctttcatcgtctcaggtcttccctctaagtctttaatccattttgagttgatttctgtatatagtggaagatgaggctgtgtttcattctgttgtatagattattctgggactgctgcatgtgctgtttcatctacttcaaatgccccctcctcctgtcttcaggcaaata

SEQ ID NO: 18603 - DNA, 419 bp, Homo sapiens
tccaacttatggatgaggctcagtgtaaataactggtctaaggtcacttagtaagtaacagtgagaatctgagtcaccacactctattcaatgggatttttgtctcttgacctctcaacggcatttcccattaggagccctccctttgttctctacttttactttcctgattatgcccctttggtttgtcttttgcccttttctctagtggcttattctcagtttcctttgtaaactctgacttctctacaggcactttaattgctagtattcctcaggaatctgtccagtctttctccatacattctactcattctctccgggtaatcccagctcttccctgggccatacctccagcttctacatgctaaggatgcccttagtctccaggtccctccagtttctcctgctcaaccctc

SEQ ID NO: 18604 - DNA, 2193 bp, Homo sapiens
cacagagagagagagagagttagtgtgtgtgtgtgtgtgtgtgtgtgtgtgtgtgtgtgcatgcatgctgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaactataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctaaaaaaaaa

SEQ ID NO: 18605 - DNA, 2140 bp, Homo sapiens
cacagagagagagagagagttagtgtgtgtgtgtgtgtgtgtgtgtgtgtgtgtgtgtgcatgcatgctgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctaaaaaaaaa

SEQ ID NO: 18606 - DNA, 270 bp, Homo sapiens
gcagacacggacggttctgctgggcagtgccgggctgggctcatgagacccacggcaaagtcggcgggggattctcaggaaaaatgtccccattcacaaaaggagccccacagagacaggggaccctgttctgccaaaccagagccactgcctttcagccaggggaggaactgacccagcagaggccccgggaaggcggtcggtctcccgtggctgccctaacagatccccacaaacggggcttaagacaacagaaatgggccggacgcg

SEQ ID NO: 18607 - DNA, 121 bp, Homo sapiens
aaatcaccatttccatacactaacaatgaactatctgaaaaagattaagagaacaattccacttacaatagcatttaaaaagtataatacttaggagtaaatttaaccaatgtggtgaaag

SEQ ID NO: 18608 - DNA, 182 bp, Homo sapiens
gggcaacacagcaagaccccatctctataatttttttttaattggctgggcatggtggtgcatgcctgtggtcctggctgcttggcagtatgaggtggagcccaggagtcaaaggctgcatggagccatgatcacggcactgtactccaggctgggtgacaaagtgagaccctgtctcaaag

SEQ ID NO: 18609 - DNA, 410 bp, Homo sapiens
ttttccctgctttcctcaattagaaaagaatcttgctcctaagcaagttcccagtttccagggaatgatgacaacctggtcactactatttgtgggacatcttgtgggggattcagaccttgaggtctctgaatgaggcttgaaatgaatgcagtcaaaatgacactttaatatttataagcatgcttcaataaggcatgtagtccacatagaaaatccctttagcatactcgttttctttccttttgagctaccgtgtctactcggtgagatggttttactctaggatttgcattccagttagcttttggaactctttatcaaagatacttttgtcatctgtatgtaaacccttagctctcactgcgaaattagagaagctacagaagaatataaagagcttagctgtt

SEQ ID NO: 18610 - DNA, 748 bp, Homo sapiens
tatgaaatgaagattgtagtttttatttcatagagtcatgaagattgagttaatctctgaaatatccacacagtgttgtcactcaggaatgatttggaatgttagggatagtcacccaccaccacagtgctaggtttcagtgaccaggagcgatgtggagctgagtctagtgggagtccagaggtaaagacacagtaaggtcacatgtgacccaggagggaggaggcacaggcagggcaatctgaggagactgtgccatggctggaggagcaggggctccaggaaggaggcagcatctgcactggaaatgcagcaggagggcccagtgagggaggcctggaaagtccacttggacttgacaatgaggagctctctgctgtcacctgctgtgattcctagagtcagaatcagactgcagtggccacaggcacaagtgggaagtgatgcagctcaaaggtttggatgagatgggatgtgcagcgattgagtcgtagctggagcgaaggatgtgctaagttagggattggaggggcgtgcatttacatgggaaagtaatgctaattagaaatcagttggacttcaacattctcaagtacttccacaaagcatcccttggttttattccagtttgttgctttacgtatttgtaagtattaaacaccaattactaaattatctgtaattcagatttgtcatttggaggaaaatcaacataatctgaatataaagcaggcagcattgagaaact

SEQ ID NO: 18611 - DNA, 501 bp, Homo sapiens
catcatctcataaaaggaattcagaaggtgctggtttaggtttagtgggaaaacgacttctgttttgacatgtagagtttgaagattaggagattgacagatgatgttgtctgacaggtggttggctgtcccagagagagatagagactccccagcatgtagggggcagagtcacaagagtgctggcctgggagatatgccagccaaggtggggcacctgggacaacagcacagctgagccgcagacacgaagacatttgttaagttatcagccacgtctgcatcacagactacaggtactaccatttagcggagttatctttgaaaagacatcaacattctcaagtacttccacaaagcatcccttggttttattccagtttgttgctttacgtatttgtaagtattaaacaccaattactaaattatctgtaattcagatttgtcatttggaggaaaatcaacataatctgaatataaagcaggcagcattgagaaact

SEQ ID NO: 18612 - DNA, 1583 bp, Homo sapiens
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18613 - DNA, 484 bp, Homo sapiens
  misc_feature (46)..(46): n is a, c, g, or t
cgttcacaggatcttacgtctgagaatcgggggctcgacgcattgnggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18614 - DNA, 1231 bp, Homo sapiens
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18615 - DNA, 1220 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggtgagttagggacacccacaacaaagagaggaggtcccaggaaactctgtagtcatagcgagggtaaacaaccacccccttggggcttcatttcagcccctaccagctatatggttatttccccctctttaagcccctgtatcccctccttttctcccaacaaggttgttgtgagttctatgagatggggttgggtagaagggtggcagctggatttctgagtagagactaaggtgtctgaaatgggaaggtggtcacctgctcagatccccacatagcatccatggagccccagggcaggggtctggctgtgcttacagggatgagtcttattgtgggttttaaaggtaatactaataaca

SEQ ID NO: 18616 - DNA, 1136 bp, Homo sapiens
  misc_feature (1073)..(1073): n is a, c, g, or t
  misc_feature (1076)..(1076): n is a, c, g, or t
  misc_feature (1082)..(1082): n is a, c, g, or t
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtcgagattctttcggnggnggctgncttgggcagggtgggggggaacggggcggcatgggggcgagaagggaggcttcc

SEQ ID NO: 18617 - DNA, 367 bp, Homo sapiens
ctagggcactgtgccaccctcattcctccagagctggtggaagaccacgcccccccccctttggggggggaaaaacccaaattttttgtgggcacctgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18618 - DNA, 926 bp, Homo sapiens
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatacgggagacgaacctcctaatgcgaaaaagccatgtgcccacgggggaccgtcagcccctgccgccccaac

SEQ ID NO: 18619 - DNA, 1851 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18620 - DNA, 1644 bp, Homo sapiens
ggacgcgtgggtccggacgcgtgggtcgacccacgcgtgcgcgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18621 - DNA, 1502 bp, Homo sapiens
aacggacagaaacatcggctagtgcgaggctgggtggtgctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18622 - DNA, 1748 bp, Homo sapiens
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18623 - DNA, 2167 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcaaaaaaaacacacggcgagccgccctagaaagaaccccgcaagcgcccgaagcatcagcgaacagcttttgggacccaagtggcccatgcaggaaacgccaactaagcacgccggggcccggagtacaacagcagggacggcgaccgcatccgcggcaggaggaccccaccgggcggcggcccagaccaccacccgcgacagccgagcagaaccacgcgaagcggcaccccgaggaaccgacttaacacaccagcccaccagcgcccacctaaccacgatccgcgccccagatcgacgagagcgggcgggggagcga

SEQ ID NO: 18624 - DNA, 1449 bp, Homo sapiens
tgagtcgtggtgaatcggacgaggccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18625 - DNA, 1923 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18626 - DNA, 2082 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcaaaaaaaaaaaaaaaaaaaaattggagagggcatttaatgttgggggtggggaaaaaagaaggtaatggaatgggccccatgtggccattagcgtgtgttcccttgaacccaagctttctcttggttcccaaagggggggtaaaacctcttgcgcgggtcctcccttaatcggagagtcggaatttaattccgagaaaaacgccagggtttacccctggggcttttaagggc

SEQ ID NO: 18627 - DNA, 1914 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcaagcactttggggctggagttctttgttggggatgatggatgtggaatgggcatgactgtgtgg

SEQ ID NO: 18628 - DNA, 1827 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18629 - DNA, 1797 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18630 - DNA, 1449 bp, Homo sapiens
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgcgtggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18631 - DNA, 2054 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagttggaggctttagggctctgctgtgacactcttgcctggctctcctctcactgctacacctccagctgtgccctgtgtccccagacccagcactgcccctgagcacctatctgctctctgtgtcaggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18632 - DNA, 1769 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaaacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18633 - DNA, 1933 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgtgagtgcttgcctggttgagggtggcagagggcacagtgagcctccaatccctgcttcacatattttccacccttctttaggcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18634 - DNA, 1759 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18635 - DNA, 2069 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccaggtaggcgccggggccacgtcgggcttcagtctacagcccggggtgtgggcgaggaggaggcggcaccagaccagttagaggactgggcccagccctgccacccagctaggcctggtgcttctgggtggtccctgcactccacccctacccgggccgcttggctgcgggacaagggccaggagtaggaagctccattctcttccatccttcccactaagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18636 - DNA, 1785 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18637 - DNA, 2136 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtgtgagtgtgccagtggggggacttcccagcttggtgagggaatgcccccctctgactctggccttccctcagacccctgctcagtatgcgctgatggagaaagacgccctccaggtggcccaggagatgaaggctgagtactgggcagtctcatctctcactggtgagttggaggctttagggctctgctgtgacactcttgcctggctctcctctcactgctacacctccagctgtgccctgtgtccccagacccagcactgcccctgagcacctatctgctctctgtgtcaggtgagaatgtccgagaattcttcttccgtgtggcagcactgacctttgaggccaatgtgctggctgagctggagaaatcgggggctcgacgcattggggatgttgtccgtgagtgcttgcctggttgagggtggcagagggcacagtgagcctccaatccctgcttcacatattttccacccttctttaggcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18638 - DNA, 1652 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18639 - DNA, 1735 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18640 - DNA, 1513 bp, Homo sapiens
  misc_feature (1328)..(1328): n is a, c, g, or t
  misc_feature (1344)..(1344): n is a, c, g, or t
  misc_feature (1347)..(1347): n is a, c, g, or t
  misc_feature (1358)..(1358): n is a, c, g, or t
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagatgtccngaatctctccgggggngcnggcttgggcanggtggctgcttggaaacgggccacctgggattgggccctcaagggtgaggccttttttggggaaccttgtccggggggggaataccgcggggggccctccacagcgcgtgtttacacctgggcgggggttcccgcgacacccgggtgtggtgtac

SEQ ID NO: 18641 - DNA, 794 bp, Homo sapiens
  misc_feature (26)..(26): n is a, c, g, or t
  misc_feature (73)..(73): n is a, c, g, or t
cacatcattcacggttgaagacaatnatgatggcttgacctcctctatagtaggttgatgcaatgcatttaancctctcctgcccagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18642 - DNA, 1303 bp, Homo sapiens
tccgagtggggtcccgagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgttcggtgtgtgtgcgcgtgtgcgtttcaataaaggtttggtacactttaaaataaaaaaaaaaaaaggatacaatagtgaaagaaagagaaacagaaagaagaagaagcagcgggccctcattgaggtggggtggcggacaaaggaggtgtctttgaattgggaactttgggaggaccagcgtttgccggtgaccctttttttttgggtaacgagggggaggggtgtctggggggtcccctcaggtggggggggctttgataataccgaagggccaggttacgcgtgcgttttgtttagtgctgtcaaaaccctatatagaagggagctcaaaggcccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18643 - DNA, 1438 bp, Homo sapiens
aacgcagaagggtggagaggagggggtggcgagggcgggcagcgaggcctggagccgccaggagaggggcggggggcggcccttctccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccaggtaggcgccggggccacgtcgggcttcagtctacagcccggggtgtgggcgaggaggaggcggcaccagaccagttagaggactgggcccagccctgccacccagctaggcctggtgcttctgggtggtccctgcactccacccctacccgggccgcttggctgcgggacaagggccaggagtaggaagctccattctcttccatccttcccactaagtgcctgaggaaggaggccgctttgcacgggcacaaagacttccacccccgcgtcacctgcgcctgccaggagcaccggacaggcaccgtggggtgagttagggacacccacaacaaagagaggaggtcccaggaaactctgtagtcatagcgagggtaaacaaccacccccttggggcttcatttcagcccctaccagctatatggttatttccccctctttaagcccctgtatcccctccttttctcccaacaaggttgttgtgagttctatgagatggggttgggtagaagggtggcagctggatttctgagtagagactaaggtgtctgaaatgggaaggtggtcacctgctcagatccccacatagcatccatggagccccagggcaggggtctggctgtgcttacagggatgagtcttattgtgggttttaaaggtaatactaataaca

SEQ ID NO: 18644 - DNA, 440 bp, Homo sapiens
gggatgcctggtgtctataataacctcagccatgggtgcagctacctttctggacctagtcgggagcattggaactccctagggtatgaacaatccggcccactccccttgcccactcttgtgtccagcaatttaagatctccaaggtcattgtggtgggggacctgtcggtggggaagacttgcctcattaataggtaagggggtgctggagctgagctgggcagggtggggccaagcctagccaggtgggctggctccagatcacagcatctggtaccctctcaggttctgcaaagacacctttgataagaattacaaggccaccattggagtggacttcgagatggaacgatttgaggtgctgggcattcccttcagtttgcagctgtgagtgcttccacaccccttccagctatcccttctccccagcacccacac

SEQ ID NO: 18645 - DNA, 330 bp, Homo sapiens
agccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 18646 - DNA, 2817 bp, Homo sapiens
  misc_feature (1017)..(1017): n is a, c, g, or t
  misc_feature (2816)..(2816): n is a, c, g, or t
tgatattttgaccttctcctttgaattatgaatgttcttaatggcatctagaatggttaatactttcgcagaagattgtcaatttattttgcccagatccatcggaggaataactgtggcagctttagccctaggaaatgttatttcttaaataataagactttaaagtcaaaattactccttaatccatgggctgcagactagatgtatcagcagacatgaaaacattaatcgttttatacatctccatcagagttcttgggtgactatgtgcattgtcaatgagcagtaatattttgaaaggcatcttttctaagcaataggtcttaacagtggacttaaaatttcagtaaaccatgctgtaaacagatgtgctgtcatccagaccttgttgttccccttatagcacataggcagagtagattaaacataattcttacaggccctagaatttttagtatggtaaatgtgcattgacttcaacttaaagtcaccagctgcattagccccaaacaagagagtcagactgtcctttgaagctttgtttccatgcattgacttctctctagctataaaagcctcagatcgcatcttcttccaatggaaagctattttgtctgcattaaaaatccgttgcttagtgtattagtccattttcatgctgctgataaagacgtacccaaggctgggcaatttataaagaaaaagaagtttaatggactcacagttccacgtggctggggaggcctaacaatcatagcagaaggtgaaaggcatatcttacatggctgcagggaagagagaaaatgagagacaagcaaaagaggtttccccttataaacccaccagatctcttgagacttattcactaccatgagaacagcacaggaaagacccatccacatgattcaattacctcccacgggtccctcccacaacacatgggaattgtggaagctacaattcaagatgagatttgagtggggcacagtcaaaccatatcacttagtgtggccnccttcatcaatgttcttagctagctcttctggataacttgctgtagcttctgcattagcacttgctgcttcaccttgcactttaatgttgcagagatggcttctttccctaaacctcatgaaccaacctctgctagcttcaaacttttcttctgcagctttctcacctctctcaacccagatagagttgagttagggccttgctctgaattaggttttggctttagggaatgttgtggctggtttgatcttagaagatcactttagacagcccactaaaactttctccatatcagcaatatgaggctgtttcacttgcttatcattcatgtgtttcctggaattgcatgtttaatttctttcaagaacttttctttgtgttcataacttggccaactgtttggcaggagaggcctcgcttttggcctttcttggctttcaacatgccttcctcactaagcttaatagttcctagtttttgatttaaattgagagatgtgagactctttctttcacttgaatgcttagtagccattgtaggattattaattgacttaatttcaatattgttgtgtctcaggcaatggggaggcccaaggagagggaaagagatgtgggaatgaccggagcagtcagaacacacacaacatttatcaattacatttgccatcttatatgggtggggcttctagtgccccagaacaattactaggataacatcaaagattactgattacaaatcactattacagataaaataataaagtttgaaatacattttttttttgagacggagtcttgctctgtcgcccaggctggagtgcagtggcactatctcagctcactgcaagctctgcctcctgggctcacgccattctcctgcctcagcctcacgagtagctggaactacaggcgcccaccacgacgcctggctaattttttatatttttagtagagacggggtttcaccgtgttagccaggatggtcttgatctcctgacctcatgatccacccacctcagcctcccaaagtgctgggattacaggcgtgagccactgcacccagccataaagtttgaaatattgctaagcattaccaaaatatgacagagacatgaagtgtgcacaaaccattgaaaaaatgtcaccaatggatttgctccatgcagggatgctagaaaccttcagtttgttaaaaaaaaaaaaaaatgcagtacctgcaaagcacagtcaagtgaagcatgataaaacaaggtattcttgaacaatgtaagaaaatgaaattccaagtgagtccatgctcaaaaaggaaaacaacgaagataccagttgaacccgtagccttatattagaagatagacaaagaaatgaacatgttatatgttttaagttcaaacattttgtggtacatataattcatcttttttattttctgctttaatcaactttttaaatgtaaccaaccaattcaaaataagaatgcttctattgtacagcagaggtatcacttcatatcagaagagttttcgtttggagggatagaaataaatgtgttctgtgtcgtgaagcatgtttttccaaggagttctaatctaaatttgggaatagttttattttttaaaatgcaccagtatattgaattgataacttgatatatttggtcctaaagtgtttttgtagccagttcttaaaatttagtttcatcatcagatttgtttctctctctctcattttaaaatctcctattaattgtgataaatatgtttctgaatgtttataataaagttatttttcgtatgnc

SEQ ID NO: 18647 - DNA, 538 bp, Homo sapiens
tcatctttccttggtttctaagtaaataacaagcatgttttctagatctgaattgttcttgcaaatatgtaatggaaaggacacaaggagaaagaacaaaaaatagcattgctttgtgaaagggcatgtggtggtatcggaaaccctacctaactgacccaaccaccagccttatggcgtcctgggcctttttggcctcttctggactgcttcatcatcctgcttcttgtcagtttcaggcgttttagagtaaattattttccctgtttgatttttctcctcactgctaaaggtttctgtaaaagcagacctgtctgtcatatcgagtaactagagaaaaggggcttttaatgttcagattttgcaggggaaaggaaaataaactaaagcaagtgactcaagagttataaatcagaaaaaacaataatgcagatattcttcttaaatgcacaggttcctgtctacacatttctcttaagttaatttgatttttcccattagctcttatttaaaaagcaaaacagacattttcctcttc

SEQ ID NO: 18648 - DNA, 695 bp, Homo sapiens
gtaaaatgcttgaaggcaggaatgtgtagatgaatttaggcaatagttggagatgtttcacctttattctgaaaatgctgaagactaaaaatttttttatgaagaataaaaatacaactgtctggaaataagattggaggagaaaacatgaaggcagggagatagcaaatcctgttgattaaaataactcagataggagagaaaaaggggtggagcaatagagaatggaaggaatacctaaaatgtgttaacaaaggaaaaacaaaatgttttatactggatatgagaaatcggaaagaggagagggaaaagttaatagacgttcaaacatagattttaaaattttctgtccaaattagtgggtaaaacaccatagcatttgtacaactgccaaaactgtttttcaggtctaaataatttgcataattactgtcagcatttctttgttccttcgttattttccaactctatttgttgaccttgagaaaattagtttccgtagtctcatacgtcttccaatgtctgtgttttctagtggaaaaagaaaagggaattgaaaacgaagacagctacattacattttgtctgatattgaatcactggccatttaatctgctccttaaaactctctttgagtcattttttccactttgaaatgtagcttcatagattcaaggacttttagtagtaaaaaa

SEQ ID NO: 18649 - DNA, 501 bp, Homo sapiens
atcggccaattagactcctgtaaaaatgtgtctccatgtttgtcctccctcctgaaataagaaattcatagctgggggtggggagtagatgggggctgggggaaaaactttctcacattcacagagcagcttccctcaaagcggcacggaatcgggaaccccactcgggacaggggaaaacggccaagttcctagaaatttgttttctttgtggggagcaattcatgatgggcgttcttgtctggtttccccccactccgtcccctgacgccgagtaacacttaaacctttctagttgcaaagtcttttcagagttttttttttaggaaataagttttgaaaattctagtgcttaaaaaatgtatatatatatatatatgtatatttatagccttttattttccctgagtacatgttggccactacattccaaattgatctcaaatggttttccagcttgttggggggtgaggaaaaataaatggagaatatatttaaatg

SEQ ID NO: 18650 - DNA, 462 bp, Homo sapiens
ctttctattcttttcctgcattaaagtttaagcattgaggaagcacttcccaagactacctgagttcttttcagctgagtctagaggtagggatagccatggttcaaaagcagcctaccacttggggtcgccctggcgtgcaccccattaaggtccctacttcaaggagcagattcttcaggctttccatcttggggtctcctagtctatcagcagtggaggaaacctctacagatgctgcactgtgtggtatggaaggcactggccacgcgtgactactgagtatgtgaaatgcatctggtccacactgagaagtgttccaagtacaaaacacacatcagattttaaagacgtagtgaaaaagaatgtaaaagatctcaatcactatcagaattgctcattgaaatgataccattcaattggatgaagtaaaatctgttattaaaattcgatttacctgtc

SEQ ID NO: 18651 - DNA, 1027 bp, Homo sapiens
  misc_feature (41)..(41): n is a, c, g, or t
  misc_feature (141)..(141): n is a, c, g, or t
  misc_feature (149)..(149): n is a, c, g, or t
  misc_feature (154)..(154): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (215)..(215): n is a, c, g, or t
  misc_feature (220)..(220): n is a, c, g, or t
  misc_feature (228)..(229): n is a, c, g, or t
  misc_feature (233)..(234): n is a, c, g, or t
  misc_feature (237)..(237): n is a, c, g, or t
  misc_feature (240)..(240): n is a, c, g, or t
  misc_feature (285)..(285): n is a, c, g, or t
  misc_feature (296)..(296): n is a, c, g, or t
  misc_feature (300)..(300): n is a, c, g, or t
  misc_feature (303)..(303): n is a, c, g, or t
acctcattaatactctaggtgtcattttatatgactagttnacaaataggacaataggtttcaaagtattgagataagggaatataaatagtattatatgtatcaggaaatctctcatcctgtttttgtttcatgtatttntaaagttntcatntgtgcacaaaaatctgtcgtggaatatattttattctcattantncngtgangntgngacntcatngtaatttnngaanncanctngagggtaaaaattttactttgtcaatactgagtctctggcgtaanccttataatcnttcnccngagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataag

SEQ ID NO: 18652 - DNA, 819 bp, Homo sapiens
  misc_feature (41)..(41): n is a, c, g, or t
  misc_feature (141)..(141): n is a, c, g, or t
  misc_feature (149)..(149): n is a, c, g, or t
  misc_feature (154)..(154): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (215)..(215): n is a, c, g, or t
  misc_feature (220)..(220): n is a, c, g, or t
  misc_feature (228)..(229): n is a, c, g, or t
  misc_feature (233)..(234): n is a, c, g, or t
  misc_feature (237)..(237): n is a, c, g, or t
  misc_feature (240)..(240): n is a, c, g, or t
acctcattaatactctaggtgtcattttatatgactagttnacaaataggacaataggtttcaaagtattgagataagggaatataaatagtattatatgtatcaggaaatctctcatcctgtttttgtttcatgtatttntaaagttntcatntgtgcacaaaaatctgtcgtggaatatattttattctcattantncngtgangntgngacntcatngtaatttnngaanncanctngagggtaaaaattttactttgtcaatactgaagtctctcctgtgggcgtaatatatcttctcccacagaacataatattgtcaaatagatacacatttttctaataggtatttagaagcacttgaaatattcttaatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaattatcgtggaacacgttgaatgtttgtgattctgtgtggcctttttggggctggaaaatgtatgaattcttcaactgtcttacaagagatctgctaataaattttattattaaataag

SEQ ID NO: 18653 - DNA, 781 bp, Homo sapiens
ccccatatacactatgttttttcctacacatacatacctatgataaagtttaatttatgaattaggcacagtaagaaattaacaacaataacttataacaaaatagaacacataatatgctgtaataaaagtaaataagacttgcttgaacgcaagcacggcaataccacaacagccaatctgagggttcctgagtgactagcaagcaggcaggtagatggcgtgagtacactagacagatgattcatgtccgggaggatggagtgggatggcatgaaattcgtcacactactcacaatggcacacaacttaaaacttatgaattgcttatttccggaattttccatttcatatttttagactgcagttgaccatgggtaactgaacctgcagataagtggggattaccatattgctgttttaagccactaaatgtggggcaatctgttatgaagcaatacgtagttaatatcccaccctaacattactgtgggtcttttgtgagcttttcgatgtccctctcgtcacaccccagccctaacccccaagtcctggggtagagagctgggagctggaagccaggcagcctggagtgagttccagccccactaattccagctgtgtgaacttggacaggtttcccagctcccctcaattccagctgtgtgaacttgaacggtttctgagcctccttccacttcaattttctcccctgccaaacatcagtcctaatggtacctacctcacatggttatgtattaaatgagttacttcatgcaaa

SEQ ID NO: 18654 - DNA, 473 bp, Homo sapiens
ctcccatgttctgtttttgtcctatcagagtgcccttttttcaatcctccctgcccttagctacttttaggatcctagtgattggtgtgttttacagagcaatgattggtgcattttacagagtgctgattggtgcattttacaatcctcttgctagctacagagcgctgattggtgcattttataatcctcttgtaagacagaaaagttctccaagtccccactcgacccaggaagtccagatggcttcacctctcagtaggcagactgagcctatttttctagaaaagggttaaaactaggaagaaaatagtgctaaggcttgaacatgttgagcccaacctcagatctaagagaatgctggtagaggaggtaagaagagaagaaagggccaaatgatccagttctaagtttcaatctttttattattaatattattgtaaagataataaagtcttaaggttaacttctaa

SEQ ID NO: 18655 - DNA, 422 bp, Homo sapiens
tcccaagtaactggaactacaggcacacgccagcacaactggctaactttttaacttttttgtagagacaggatcctgctttgttacccaggctagtcttggactcctggactcgagcgaccctcccaccttggcctcccaaagtgctgggattacaggtgtgagccatcatgcctgggtattttgaaaaccttaagatacacaggtataagatgttattatttactcatccattctgcaaataaaataacctatcacctaaactgagttttcatgggataaataagagttcagggccgggtgcggtggctcacacctgtaatcccagcactttgggaggccaaggcgggtggatcatgaagtcaggagattgagaccatccaggctaacacagtgaaaccccatctctactaaaaaataca

SEQ ID NO: 18656 - DNA, 485 bp, Homo sapiens
tcccaagtaactggaactacaggcacacgccagcacaactggctaactttttaacttttttgtagagacaggatcctgctttgttacccaggctagtcttggactcctggactcgagcgaccctcccaccttggcctcccaaagtgctgggattacaggtgtgagccatcatgcctgggtattttgaaaaccttaagatacacaggtataagatgttattatttactcatccattctgcaaatatatacccctattacctagactctgttgaggatagaggccgtgctttttcccacgtgtggagtagagcaacatagaagagtgccctgcagtgggtgctgtaatggagatgtgtaccaggtacaacaggaacctaaggaaggaacccctgagtttatcggggggcaccagggaaggcttcacagaggagatgatgtgagttgccatttgaagaatgagaaattgtttttctgatgaactaaac

SEQ ID NO: 18657 - DNA, 2641 bp, Homo sapiens
aattctagggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcaattgttcaatgtggtagatgaaaatcatggcatgaattccagctatgccttgacctggcagaaggttatctctagcttatcctcagttcttagtaactttacccactagtgaagagatactgtctattttcaatgtggactcggaaaaaaagacttataagtaggaagacagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgct

SEQ ID NO: 18658 - DNA, 887 bp, Homo sapiens
aattctagggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgct

SEQ ID NO: 18659 - DNA, 2302 bp, Homo sapiens
tctcccatttgctcctcaaagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccaggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcaattgttcaatgtggtagatgaaaatcatggcatgaattccagctatgccttgacctggcagaaggttatctctagcttatcctcagttcttagtaactttacccactagtgaagagatactgtctattttcaatgtggactcggaaaaaaagacttataagtaggaagacagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgct

SEQ ID NO: 18660 - DNA, 1318 bp, Homo sapiens
aattctagggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtaagtaaatttctgccatgtaagttacagaataagttcttatttgaagagaagctcagtacaggcatagcacaatcagactctgaaatattgttagttactaccccatttttgaaaaattataacctgggagaaattgtggacacagagtctaaacattgtggatatgaatatgcaaatgcagtcccggtgaaagtgcatccacatgaaattaatgaacttgagaagtcagcatggagataccacc

SEQ ID NO: 18661 - DNA, 2599 bp, Homo sapiens
aattctagggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcaattgttcaatgtggtagatgaaaatcatggcatgaattccagctatgccttgacctggcagaaggttatctctagcttatcctcagttcttagtaactttacccactagtgaagagatactgtctattttcaatgtggactcggaaaaaaagacttataagtaggaagacagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgct

SEQ ID NO: 18662 - DNA, 1696 bp, Homo sapiens
atttttcaaaaagagaagatctggcccttgatggcaatttagggttattttaatttattaccacatgtgactcccatgagggaaacttgtccccatcagccagccaatgagagacagagcatttacgtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcaattgttcaatgtggtagatgaaaatcatggcatgaattccagctatgccttgacctggcagaaggttatctctagcttatcctcagttcttagtaactttacccactagtgaagagatactgtctattttcaatgtggactcggaaaaaaagacttataagtaggaagacagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgct

SEQ ID NO: 18663 - DNA, 500 bp, Homo sapiens
ttatattatttatcgagtttatttacttgtgttcttatttgtctttcccacaagactatgtgttccacatggtgggaactttgtcttatttaccattgtaccccattgcctagaccagtgcctgatacatggcaggtactcaaaagtgcagggtgctctatccatgaaggagagtgtccgcagccttatccctgttctcattcttggcagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtaagtaaatttctgccatgtaagttacagaataagttcttatttgaagagaagctcagtacaggcatagcacaatcagactctgaaatattgttagttactaccccatttttgaaaaattataacct

SEQ ID NO: 18664 - DNA, 1208 bp, Homo sapiens
cttcacagtagcgtgataactgaataatacatgtaacaattacatgaacaaattattacaagtttgaggtacatcaggtttaaattaaggaaaaatgtttaaagaattttcctcctcaatgtttcttagggtcgaagaggcgtttatgtttgtttatgaataggtcctcgaaggtaaaacataggctttaacattctgaggccaaggatggagctgtgtctgatttataaagtttcagacgcagtagaacaattgacatgagaaactagtcttcctctgaggctggtgaagctgcagatcagcacacactcagacttggtacagagaaacagaccattctcccattagcctttggtatacttcagtcacctggggtagagtgatttctgtgatttctaaaccttctgtcctactcatcttacaggccatgtccatcctcagaactcatgctttcctttattgtagcttctgttctacgactcctctaatacatttttcttaggagcttcattgagatataatttatatcccataacattcacatttgaaatgtggcatccagtgttttttattgtagtcacagacttatgcaactatcacatcgaattttagaatattttcaccgccctctgaaaaaaactaaataacaattagcagtagctccccgtttcttttctctgccaaaccactagcaactattaatctattttctgtctttagccatttggcattccgaacatttaatacaaatacgatcatttaatatgtggtcatttgttagtttgtttctttttaaaatatgggctttttgactggcttctttcactttgcataatgctttcaaggttcatccagattttagcaggtacacatacttcattccttttttatgcctgaatgatattttgtggtattttttgctgttatgaataattcactgtttggccaccgtaaatatgcatgtataagtcttttggggacatgattttattttggaggatagatacttagatgttgaaatattggttcatataatagatctgtgtttaaatatttgaggaacacttcttgatggtattgtgacacaaatctattatgcatatatgtatgtatttacattgagtatgcttttggtgtaatatctatcaaaggttatgaagatttactgttatattttcttctaagaatttacaattttacctcttaca

SEQ ID NO: 18665 - DNA, 284 bp, Homo sapiens
aaccttggagggacattataaacttttatactttttgtttttcttttgcaatctttaaaatgtataagattaagattttttatttctggagcaaaaactaattgctatactgaatgaactgttgcttttaaaactgttgtttttaaagtctatatgaagagatataaggattactttttatattctgccattatatttgtaataaaagtaactttttttttttgtctgagacagactgttgttctgtcccccaggctggagtgcagtggcgcgatctcagctca

SEQ ID NO: 18666 - DNA, 218 bp, Homo sapiens
aaagtcccacagggattccaagatccacctggtacttaccaagcatcagcccaaacactctggacacggagaggtgtggcgccttttaaaggagacacgtggaattaaatttgctaatcacttctcgtggactgggcgggcactccaactgtatttactgagccaaatgataaagagttgatctctggattcatctgtactcaacatgaagtggtact

SEQ ID NO: 18667 - DNA, 295 bp, Homo sapiens
agagagcattataacatgccccaagggctttggggttgcaggcacccccatctgggcactgtcacacagagcttgctcttatgtcagtgcccagagagtctggccaagtcccacactcacttgctcacattctccctctcacaaggggttgagcatggtaggctgagaaaacatatacccctgttatgagtccaaaaaatggtctgagaaaatcctgcatcactttaattatcaattagactctatctcttttatatttcttaactccctctttccttttattcctgtaataggt

SEQ ID NO: 18668 - DNA, 461 bp, Homo sapiens
gggaagaagcgaggggtgtgcacatgtatgcatatttatgtacatgcatacaataagtacaaatgtctatgtctatgtttaatatattatttatgtggtttcaagttgaattttttactttgttctattttgcttattttcattgttaaattagatttcctgtttgtttgtttgtttgtttgtttcttgagatggagtcttgttctgttttgtttgtttgtttgttgagatggggtcttgttcttttcctcaggctggactgcaatggcatgtagctcactgtaactttgaactcctggactcaagcaatcctcctgcctcagtcttccaagtaactgggacctaagccctttctatttttctcttcattgccaaacttttaagagtgtgcacgcagtaactgctttccagatactcaactgcttaccttaagagccctgaagcctgacttctgtctctct

SEQ ID NO: 18669 - DNA, 490 bp, Homo sapiens
agtaatcagggtctctgtggtgtggggtgggctcaggcaaaacgtgtaacagtggcttaggtattgccagtgcacggccagggttgaggaccactggcctagagttgagggccacagcatggctgccttccagagcccagtgggagctgcagatatatgaaggataaaaggactattaggaagaggagagcaagaccaaatcaaggacattcagatttttaaaaaatcaatgtaggctgggtgcggtggctcaagcctataatcccagcactttgggaggccgaggcgggcagatcatgaggtcaggagatcgagaccatcctggctaacatggtgaaaccctgtctctactaaaaatacaaaacaattagctgggcatggtggcgggcacctgtagtcccagctactcaggaggctgaggcagcagaatggcgtgaacctgggaggcagaggttgcagtgagccgagatcgcgccactgtactccagcc

SEQ ID NO: 18670 - DNA, 394 bp, Homo sapiens
ttctggatagtcatacataaaacactatacagcgatgagagttaacagtctactacaacaggcaaaataaaatagataactcacactaccataatgttgggcaaatgaaaccacactcaaaagagtaggattctacttacattaagtataaaacaggcacaactaatctgtagttttacaagtcaagaaaataccggtagtgatggaaaagaacaagcaggggcttctggtaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaaccggaattc

SEQ ID NO: 18671 - DNA, 868 bp, Homo sapiens
aatttttaaattttattctagtttcaggggtacatgtgtaggttggttctataaataaattgcgtgtcttggggcttggtatacatattatctcatcacccaggtaataaaaaatacagaaagcttcacaaatttgtgccatccatgtgcagaggccatgctaacctctgtattattcaaattttaatatatgtcctgctgaagtgagtactggatgtggtttttaaaaagaatttgtgtattcttaggagacgcatgttaaaatatttaaggattaagtgtcacgatatcggcaacctactgtgaaatggttcagaaaaataaagataaagctaatctggccaactgttaactgttgaatgtaggttgcagctatattagtgtttattatggttctttcaacttactggtaaacttaaaatttttattttaaaaaattttttagagatacggtctcactctattgcccaggctgtagtacaatggcaccatcatagcctattgtaacctcctactcctagactcaagtgatcttctccgctgagcctcctaaatagctaggactacaagcatgtcaccatgccaggctaatttttcattttcttggagagatagggtcttgctatgttgcctaggctggtcctgagcttctggcctcaagcaatcctcccgccttgaactcccagagcactaggattaactttgcctaacccccaaattttcatagtaaaaaaacgaaaaaagaaaacttctgaataacttcctcctatcagctattactccatttcctttctccattttgaagcaaaactcttagagctgtccattctccaccctggctaacatggtgaaacccgcctttactgaa

SEQ ID NO: 18672 - DNA, 277 bp, Homo sapiens
tgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccag

SEQ ID NO: 18673 - DNA, 601 bp, Homo sapiens
tttccagcaggattgagttcttggtgaacatcctcttcctggtctacagagtactgtgttacttaagtggaaaaagtagggtgagctggttctctggcctcttcttttaggggactaattcatgagggctccaccctcatgacctatttacctcccaaaggctccatctccaaataccatcacaatggggattagaattcaacataggagttttgggaggacacaaacattcagtccataacaccaagtacagtccacaaggagcacaactgcccttgggataagaataatagtaatagctaacatatatggagtacttaaagaaagacagtctacctagcacttgacatacattatctaacttaatctctgagactctatgaggtaactactattattgttttaagtaaaagggtatcaaaaccttgacaggtcaactaacttttccaagtagcatctagtaaatggaacagctaagctagatttgctggattccaaagccccagcttttagccaaaccctctgtagatctacatatcattattttttgtttcccagtcatgagaaattccattgtaaataaatatgcttccacttgaaa

SEQ ID NO: 18674 - DNA, 462 bp, Homo sapiens
cacttaacatatgtccaccaagtggtatgtacaagaatatccacagcatctttattcataactgcccaaggacaaacaagccaaatgtcccatcattaggagaatggatgaataaattgtggtaaaatcataaaagggattactacatagctataatcacataattgatgaaaaaaaggcatgattccaattatatgaaggtcaaaaacaggccagatgactctcaagtgacagaagtcagaatagtggttacctcaagggatgggggcttctgactaggaaggtaccagggaggcttatgtggtgatggaaatgttctattattttgatctgggtggtgagcacccaggtacatgaatgtgtaagaattcatcaagttgcacagttaagatctgtgcatttactgtacacatgttctacctcaataaaaaatttaatatcatatcttaaatgtatcaagcc

SEQ ID NO: 18675 - DNA, 173 bp, Homo sapiens
acctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaag

SEQ ID NO: 18676 - DNA, 413 bp, Homo sapiens
ctatatgatctcacttatttgtaggatctaaacaaaacaaaacgaaatgaaacttcaagtacatggaaacagagaatagaagagtggttaccaggaatgaagggtgtgggagaaatgggcagatggaggtcaacgagagtataaaatttcagttatgtaggacacgtaagcacagagatttactgtatagcatgaggactgtagttaataatattgtatactggaaatgtgctaagagagtagattttaggtacttgtaccacacacatacaaagagtaacagtgtgagatgatggatatgttaattggcttgattacagtaatcatttcactatgtgtatatatatcaaaacatcatgttatataccttaaagagatacaattaaaaaatagccaatgcaaaaatgcaaagt

SEQ ID NO: 18677 - DNA, 706 bp, Homo sapiens
  misc_feature (540)..(540): n is a, c, g, or t
  misc_feature (549)..(549): n is a, c, g, or t
atatgcaagtcaatagatgtgatacatcatatagatagaattaaaaacaaaaaccatatgatcatctcaatagacacagaaaaagcattctataaaattcaacatccctttattctaaaaccctcaaaaaaatacacatagaaggggcttacctcaaaataacaaaagccatataaggtaaacccacaggcaacattacgctgaatggcgaagagtttaaagcattccccctgagaactggaacaagacaaggatgcccacttttaccgcttctattcaacataatactggaagtcctaaccagagcaatcaaacaagggaaagaaataaaaagcatctgaagtggaaaagaataactcagattgtcacgattcatcaatgatatgataatatgcttagaaaaccctaaagactcatccaaaaagctcctagatctcataaacaaattcagtaaggtctcaggctacaaaatcaatgtacacaaatcagtaggcaccaacaatgactaagccaaaaataaaatcaagaactcaatccctnttcaactgntgctgaaaaaaaaaaaaaaacctatgaatatacttaatcaaggaggtgaaagacttctgcaaggaaaatgacacagcactgctgagagagatcatagatggcacaaacatgtggaaacacataccatgctcatggatgtgaaagaatcaatattgtg

SEQ ID NO: 18678 - DNA, 323 bp, Homo sapiens
ccagtatgaattaagagaggagccacttttaaagtaatcctggagaaacagttttgttactttcaagtatatataataacctgaacagactagtggtgtcgtttacatacagattttcagtgaatctatattaatgaatggataagtgtctagagactgagctggcagttaatagatctcaagatacgcactttctctgtagatgttaggtactgatgatagcctcaaagatgttttaacaaatgagacaggctattcttttggttggatatacagtttgccctccatatctgcaggttctgcatccatggattcaacctacc

SEQ ID NO: 18679 - DNA, 486 bp, Homo sapiens
attgggataaatgcttgagggaatggataccccattctctgtgatgtgcttatttcacattgcatgcctgtattcaaacatctcatgtaccccatgcatatatacacctactacgtacccacaaaaattaaaacaaagcacggccgtttgtgcagctttgcatttccatgttctgggacttctctcttgtcttaaatcactttcctctgcacaagagtggcatggcccacacaggacgagctccctgcctcctctccccagagccaatctagatagaaacacggcgacgcagctgttgtcacacgcacccatgccagaggctgcagacgatggctagacctctacaaagaggcattttccaagtgatcctgtgaccccacgcagaatgatggtccccgcctagatatcagagcgttcctcacactgcaccgagctggcccatctcttcctcagtttgcactccctgagtgacctgtcttattcacc

SEQ ID NO: 18680 - DNA, 389 bp, Homo sapiens
ggccccagcctctttttctttcctcctgtaacttgtgtcctgtttctgatttctcaccaattatgccatctgcctgtgcccttggtaacatctgggtattgtgtgtgctgcagacctcacccatgtgagacaggtcccctcactcgccggccaccagaccccagtgtagtgggcgtctccagcgtagtgggcgtctccagtgtagtgggcatctccagtgtagtagacctctccagtgtaccaggcctctccagcccacactctctgagatgtaagatcacgtagttctcaagtatttattggcttgtatttttctctttgtgaagtgaattccaatctagtagctgcagctatgtacgaataaagaagggtttatttttctgtccgta

SEQ ID NO: 18681 - DNA, 188 bp, Homo sapiens
ggggagctccctattgttttagtattatgaatagccaagtatacttaccaaatattagaattggtaaatatttaggttttttatgtaaggggataacggaatgggaaggtattgctgacttttcagataagctcctggttgtattatgaatgcagggaaatctccttttattagacatcaaatccttc

SEQ ID NO: 18682 - DNA, 399 bp, Homo sapiens
tactttccctctctgattttccagtctttgttacctgtaaatgtaacaatgcctttctctatgttgttgcgaagtccacataaagtgacatgaaattgattataaaatacaacacaggctgggcacagtggctcacgcctgtaatcccagcactttgggaggtggaggagggcagatcacttgaggttgggagttcaagaccaacctgactaacatggagaaaccccgtctctactaaaaatacaaaattagccaggcatggtggcacatgactgtaatcccagctactcgggaggctgaggcaggagaatcgcttgaacctgggaggtggaggttgcagtgagcggagatcacaccattgcactccagcctgggcaacaagaacaaaactccatctca

SEQ ID NO: 18683 - DNA, 749 bp, Homo sapiens
agtttaaccagcttaattaatgatttttccagtttgaagcacttattttcccaatgtgaataaagggaaaagatcagcaatttgtccctggcctttttcgaggccatttttagttttctgcccccatttcccagtcctggtataaaatgaattacgggtatccctctaagtccctataaccctttttgggggtcacagatatctttgataatctgatgacagtgtgatggatcctctacccaagaaaaaaaaaatgcccatccctggataattttgcatacaacttcaggggcatcacacatcttctgaaacccaagttaaagatctctgctctaagtaaattgtagagaattttagtgcaaatcgttgataaaattaggaaccaactattggcttaaaacctttcatattggaattattgttagatggtggcccctactagcaaaatgtgacattgcaaccagcttcgttagacattataacaaccagagagaagggaaaaaagcaaagttctgaaagctatttataaggagtcagggcatctctagacatgggagccttcctggttcaaggcaggggtcagggtgcctgacaatttctagcagggtagagtttgataaaccacaatgctcaggatgccaaggggttagccattatcttaaccccttcctcaccaaaagattttagttttgtctgttgggaaacaagatgtcactagggaaaaaaagatttgccttacaactttgctg

SEQ ID NO: 18684 - DNA, 170 bp, Homo sapiens
aaacactttacttttttttaaaacaatccttgctctctggagatattttctcacattttgttacaaattttgtgtagaagcatagccacagtggattttttctggctctttttctttctctgagacgttaatgtccagtagagcaaagctagaaggatatatatatatat

SEQ ID NO: 18685 - DNA, 407 bp, Homo sapiens
gaaacaatagtcatgtgctgacccagctagaaaatatgatgcacttgataagacacagtgggtgaggtctgagaattgttgtcttagtacttacctatccagtccccaaggtcagctgggaggttggaataaaaacaatccaggatcatcatgacaggtttagtccagagctctccaccgccatcagcagcaccaccaccttccccttgattgctccaaaggtcccaaattctgtgggttggagttgaaatgcctcaataagcactagcatttgcagaacagtctcagccaggcattctctgtgccttctctcaagaggtagtgacctggtaactcttcaaacctccttgcaaagagctgctcagccacagtggatagattttgcccctcctggtagccttccactc

SEQ ID NO: 18686 - DNA, 451 bp, Homo sapiens
tatgggcaggcaaattctcaaactttttggttagaactaaccccattgcactcttaaaaattactaaggacccctaagaatcttgatctatatgggttaaatctatcaatatttaccacagggcaattaaaactgaagcatttttgaaatgtttatttattttaaaacaataataataaacccattttatgttaacataaatagcatacttataaaaattattatactaaacaaaatattgagaagaatgtcattatggtatatttctgcaaatctctttaatgtgaggcttcataagagacacgtagaatcttaaatctgctcctacaattaatctgtgacaatatcacactgttcatatgtcaatgtagcctctggaaaactccactgtacactcattggagaataagagtaaaaagacaattaatctcttaaaattatagattattat

SEQ ID NO: 18687 - DNA, 395 bp, Homo sapiens
cccaggcaagagtacagtgacacaatcatagctcaatgcagcctgggactcctgggctcaagtggtcttctggcctcagccccccgagtagctaggccagaagctactgtgtgttatgcccggcttattgttattattattagtagtaatagtagtagagattggatcttgccatgttgcccgggctggtttcttgctatattgcccaggctggtttcaaattcctggcctaaagcgatcctcctcagcctcccaaagtgccgggattacaggtgtgagccaccatgcctggcctcagttatagtatataattggagtcccacaggagaaaggagagatgataatggctttttttcccccaaaaccaatgaaagataccaagccacagtttaaag

SEQ ID NO: 18688 - DNA, 420 bp, Homo sapiens
gaacaccaaggttgcggcagacaccagaagctggaagaggccaggaccgcctctcccctaacgccttcagagaaagcacagcctggccaccaccttcatcttcgatttctggcctccagaactgagagaatgaatgtctattgtttaagctgccagtatgtggcactttgttacagtagccctagcaagctaacattcagtatgtctgaagggtagtcaagaggaagctagaaattaagatgtcggcccatgtttggagtggatttaagccaaacagcgtactatgtgtgccctgctaaaaattataataacgagaaattgttacagcctaagagtgaccccaggatttgtaactgacgttgagtgcccaagaactgcgtgataagtctattaagataaaattatttcaagtcctcactt

SEQ ID NO: 18689 - DNA, 112 bp, Homo sapiens
gcgcgctccacagcctgtcgaaaaacactcgggaagcaaacattgagaagaaaatactccttctgtgggcctttaggaaaaccgagtgacttttttcgtgaggggaacccat

SEQ ID NO: 18690 - DNA, 258 bp, Homo sapiens
gggggcggcaccaggacaaggtgggggcagcccagtgtgcatcccttcctgtctaacccttcgtcactcggctggtccaccaacaagaactgcttaacctggggctgattctgtgactccccatttgaccacttctctgccctagagggcagctgagagagaaggaaggaaggaagtagattctctttggtccttgttcccggcttgggtaagagaaaggaggtgttcgctcctcctgagccaggccctggccacccc

SEQ ID NO: 18691 - DNA, 198 bp, Homo sapiens
ttttgcagggacaatctgttggtgagaaactcccttaatttttccttgtgtgagaatgtctttatttctccttcacttttaaaagataattattctggatacagaattctaggttgatgggtttggcactttttttttcttaacactacaaatattgtagtcccctctcttcttgtttgcattgtttctgaagagatg

SEQ ID NO: 18692 - DNA, 367 bp, Homo sapiens
actaaaaataaaaaaattgccaggcacagtggctcccaaagtactgggattataggcgtgagccgccacatgcagccacacagatttattaatgtgggaagcctgctctgcttgtggtaattgctgttctgtgccctgcccctccccactccccttggcccttttctgtcagttagcaccaaagggctcctaggctacttctcattttcttgttctataaaaatgtggttgaaatccattcagctctttccaggccttccaggaggagccctccacaggggtatttgcacgcgtcagcttttttgcatgttcaactttaacaagagtttgacttctcccagaatttgactctacagcaagctttcct

SEQ ID NO: 18693 - DNA, 343 bp, Homo sapiens
caccagcaggctcccatgctctctgtgtcctttcacggaaaataatatttcccttggagggtgtgtaggttttaaattgggtgatcgtaaaagcatcggcgcatagagtgtagttcagtacatgttaattttctttttttccatccaacctctctttgattttatttgatttttaaaaatctctttagctgggcgcggtggctcacgcctgtcacccaccactttgggaggccaaggaggccagatcacttgaggtcaggagtttgagactggcctggccaacgtgatgaaaccctgtgtctactaaaaatacaaaaattagccaggcatgttgacccaagcc

SEQ ID NO: 18694 - DNA, 868 bp, Homo sapiens
ctggactttggccactacgtatctcacaagaatagaatacaaatagcgaagcctactgttgataccaaacctccagtggcgcacacaaatcacattttaaaattgagcaaactacagggtgaacaaaagaaaatcaacaaaatcgagtatgaaaacaagcaactgtgtcagaaaatcgcaaatgcccatcgcggccctgccaaggtggattgctggaatgaatatttttccaagagcttaaacagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaag

SEQ ID NO: 18695 - DNA, 826 bp, Homo sapiens
tgtcgccagccgtttgtgatttattcacagggagaccttcccccaaccagaagttctcaatcctggttttacattataatccttggggaattttaagaaaatgccagtgtgcacggttcacctcagatcaatgaagtagaatcttctcatgggcaacagggttgaggaccactgatataaacctgcgaatgcggtgcatgtttcccggagtgcagtgcagaccaacaggctgtcccaggggcctgtgggctcagcaggacagtttactccctgcacttagacagtctggcatttatgatctcatgacttcatctcccccactcgtcaagatgagcatttccttcttcacccatttcggggttttgtgtttttcaggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaag

SEQ ID NO: 18696 - DNA, 1007 bp, Homo sapiens
tgtcgccagccgtttgtgatttattcacagggagaccttcccccaaccagaagttctcaatcctggttttacattataatccttggggaattttaagaaaatgccagtgtgcacggttcacctcagatcaatgaagtagaatcttctcatgggcaacagggttgaggaccactgatataaacctgcgaatgcggtgcatgtttcccggagtgcagtgcagaccaacaggctgtcccaggggcctgtgggctcagcaggacagtttactccctgcacttagacagtctggcatttatgatctcatgacttcatctcccccactcgtcaagatgagcatttccttcttcacccatttcggggttttgtgtttttcagcttaaacagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgtggaagaagaaaagctggggtgagatcatccagccacaagtacagcactgtcaaaatggaaaacgaaatcacatgacaacatcaaggttcagaaaacacaaggaacaaatgccattagttcctctgtgaatacacacgatcggaaaag

SEQ ID NO: 18697 - DNA, 278 bp, Homo sapiens
gattaatgaaggcatttgtcaaaaagatttgtaaaatgactgtgaattccttaggcattggtatttgagatgtaaaatgaaaattaagcacatcatatctgtttttcaagaagcaatagattgataaatgttatcctgccattatactttgggtaagaaaagtgtgtctcattgattcattcaacaagtttatttacacacatatttgcctgccatgccctgtgctatgcacaagggatacaactgatgatcgatattatgtgtgaccccttagaagg

SEQ ID NO: 18698 - DNA, 414 bp, Homo sapiens
aactgtcattatttccaggtgatgtgattgtttagcatccaaaagaatctacaaaagatttatgagagtcagtaatgaagaaatgctggttgtaaggttgatagaaaaaaacccaattatatgttcatataccagaaacagaaaatgaaaacttaaaattatgatatacggtagcagaaaaagccctgtaaatttgtaggaatgaatcttaacaacaacaaaagtaaaaacaagtaaaggcacaatcaaaaaagctctacatttttgaggctagacatggtgtctccagcctgtaatcctagctctttgggaggcttaggcactggggtggagtgggggtgaggatggcttgagtccaggaattttgagatcagcctgggcaacgtagtgagacctgatgtctacaaaaaagtt

SEQ ID NO: 18699 - DNA, 357 bp, Homo sapiens
aaattagagttaaatactctttatagatagttacttaagaacatcaaactgtaatgtgtggcttagagtatccataaaaataccttatctggtctatattgaaagtgaataatttactcagtcagcagttattcatttaataatttaatttgattttgtatgtttaaatgcttaaagatttcgctacaaaaaaaccccacaaaaaaacctcaattgtaaggaatcttaaatcttaggtgttttatggtttttggcaatttttataaagcaaacaaaccatggattagaagaaatcaattttacagaaaaaggtaattagtgtattttctggatctggtatcttccatggtaccaagt

SEQ ID NO: 18700 - DNA, 388 bp, Homo sapiens
cagggaaagaatgaccccagccccctgggaaaatgagggctgaaggtggtggcgatagagaaggaagaacagatgtttaggaagtggagtggaagggctgaggcagagtaactgtgaggttaataaagggggtgtcaaggaggatgcccacagcctgacttgatgaatgacctgggtggtgggtttatgagtcaacgtaggggatttatggggaagaaggcgtgggtttgagggaagacagaatgatggttaacacttgtcgcttaccatgtgccaacgtctgctgacatgctattctgtactctccgtaacaggcttctgggtgaggtgtccattagtaatgccctcattttataattcagggagtgagttaattaatgtgcccaag

SEQ ID NO: 18701 - DNA, 973 bp, Homo sapiens
ggccattggtgggagggtccctatcagtcctaaatcatactgtggcacaaaggaaagagaaggccagctttgaagcctgtggagatcttgtccaagtcactcttctcctgtgagatggtttcccttcctctgccaaaagcagagtttggatcagatagaagtaattctgcttgcagagttacgtagacgattcagcgatgattatagcacttcagcaattccatcaaataagcccacttttttttcacccccctaaagacgggctctcactattttgcccatgctggtctcagactcctgagcttctcccaccatggcctcccaaagtgctgggattataagtctgagccaccacacccagcctccagacacacttagtattagcaacaaacactgatactgtttggtcttgaaagtgacggtcagtgcccactactagtccatgcaacaaggctagaggttagaaaacttgcttagggcagactggccacaggaaagggactgttgaagggaccactggaagaccaggtacctctagcagcccagacccatgtatagggcagctgatagagtgccagtggcccagcatctggggggtggttagtagtgatcatgagctcaacaggggcaaagcccagggggtccatctgtacctgttttgcccatcagataccaattgggaactttatcttctcttgaaaccatagcctgtaaccaggtcaccatgattaatgtgcatataattagcaaagtacagagaagccatagaaattccctgtgagaagatgcaaaactcagtgtgggaaagcagagtcctcaggaatacacggaagtgggaggaacccggggcttacctcacacatcttggccatagccgggaatatcacaggcaggccgacaactgtgtgacaaagggctgtcttctaatcacacaaccaaatggcaggagaaccaccctttctccatcacctgc

SEQ ID NO: 18702 - DNA, 693 bp, Homo sapiens
tggcaaaatacatgatcgggaagcagtctgaatttaatcaaggggatgtaccattccattgtttatgattatgatctcatggattaggttgggggttagcaaactgcctgcaggctgaatctagcctgatgcttgttcatttatatattgtctgtggctgctttcacacaatggcagagttgaatagttgaggcagagaccatgtggcctgcaaagtctgaaatatatctggcccttcttttacagaaaaagttcgtcagtccctgaaccagatcgtctgtttaagtggagctaaaaagaatggctacgagattaatttttaattattggtctatttaagtaccaggtacacaaatacatttttgtcatattttcttcaaaatttcagtttgagattggagcatttgtataaagatgtaagttaataccattactcagctcacatacgatagcacttaagtggttttcttttgctctcaaatactgaaaatactaatctaattgggtttgttcaagatttttcattgaattgtggggaaaacatttccccagagtctggctatcactgatcagtttgtagtgcccttcatcccacaagccactgtcatacgtaaagggatttcaaatctcttaagttccagccctcgacctccccctcctgatctctgcttcttcctgtcctctggacagttt

SEQ ID NO: 18703 - DNA, 405 bp, Homo sapiens
atctgattatgtacccatttatgaaaacaaacgcttacccatgggaattctgttctaaaatccagttaatgtagttcagttgttacattgcctttttagtgtgttaccaagaaaaaggaaaagaaataaaaataactgaaatattaggtgcaggctggctctaataattagaaagggtgctctagcatgttgcgtctcagtgtgttatccagtgaccaggtatgtcagcacctcctgggagcttatgagaaatgcagaatctcaggctgcaacccagacctcctgagtctgaatctacattcaacaaaaactgcaggtgactggtgtgcacatttaagtttcagaatagccaagtgcatgtcaaaacattaaaataaaaatcaggagatctggtttctggttcta

SEQ ID NO: 18704 - DNA, 563 bp, Homo sapiens
gttactgtaactttgtagtacagtttgaagtgggtagcgtgatgccttcaggtttgttctttttgcttaggattgtcttggctattcagctcttgccactttttaaccatatgaacacgttatcttaaatactctgagcctcagatttttcatcagtgtaatgggaagactatttcccttacaagactgtgatgaaggtggactaagatttgtgtgtatctaaggcttatcatagcaccaaggacaccgttaacttgctgtatttggctgtatgctcctttcccctaccctctacacacccagaatggctctttgataaatagtgacttcctagtaatgatttaccaagaaacatggttagagtgaagagtagatttgctagaagttctcttgcgtggtggtgatttgaattcatttccatctgtaaacaggattccttggaccagtcttggagtacagcttcatatagttgctttaggttttataaacctaccttttaaaatagcctttgcctctctctacattgtctgcagtaaattaagttacaatattataatttaata

SEQ ID NO: 18705 - DNA, 376 bp, Homo sapiens
agaagtaaagaaaacacttgcatatgtttctatttgtgaagcagatacatattgtgaagttcattgtaacagggcagatttgtagcctgttaatattctcgttacttaagaccattaacttttccatctaataaaattattagaagcatagatttgtgtttcagcatatgacaaacatcaggcagatagatgtctgatagcagtcagtgcttgtaggtattctagttgatagtaatgacaaatcttttaaaaagtagatgattaactacagtgatgaagatacacagaaagacgatgagaaacagcatgagcagatagaaaaggaaagaaatagaaaaaaaaaaagtcgacgcggccgcgaatttagtagtagtag

SEQ ID NO: 18706 - DNA, 422 bp, Homo sapiens
gagaaaattctgggagttgcataccggccagtcttattctctaaagttgttccttctaaagggtgtgatgaccgaaaatttcagaaaagcaaaccaccgctgaaaggcaacgttatttctgttggcagaaggcggcctgagcaatctagattttccacggttcaccaattagtttttaaggaaatatggctgtgagaggaataaaacatgattcctacctttaaggaactcagagaagtgaattaaaggaagtcacagatcagacaaccaaccacacaaagtttctaagagcaaactgttcaggtcggcaagtcactcttatccactgttttgccttctaaggtttcagttactctcagtcagtcatggtccaaaaacattaaatgaaaaattccagaaataaacaatacacacgtgttaaa

SEQ ID NO: 18707 - DNA, 446 bp, Homo sapiens
caaaggtgttgtgctatgtaagtaatgtacttattatcacatatgcgatgcaaatggatgcaacattctacagaatacttcgggaaaatagagaacgtaaaaatgttctgattttaatcacaaaataattctattcagaagttagccacgagagggcagcattgtctacacaaacacagaatggcgactgcatttgaacctcagacattttcgtgaggctgtttcaccatttggtttcaatcacagggaatgatcatagaaacagcatcattgatgcttaaattcacagtttttaaaataaaaactctaatctcttcgtctgcgcaaccattaggacaaggctaaatatcgtggaacaatgacacatatttttcttatatttctctgtcttttccagcatgtcttctttacgctctacgctccgtttctgtagtttacttactttg

SEQ ID NO: 18708 - DNA, 468 bp, Homo sapiens
gaggaagctgaggcacagggcatttcagcagcatactcaagattctacagaacgactaagtagcagagccacagtttgaacccaggcagcctggccccatggccagtgcccccaattataatatgaccctcccaggtactgcccaaccctacccaagtaccgaataacgagggatggagttcaggccaccttgcaggcaaagtcctctgccagctcgtggactgccccttgggtcacttcgaatacatcggcatagacttgcactttgcagtgcccccacccccaactcagcagcccacagtcaggctggcaaacagcaccgagacattgataatacagggggtatgtgtgtcaagggcacggggtgcctgtgggcagcttgcccaggctgtgcatggtggcgaggcctggaaggttttgcaagggcaaggcttgagctaaatcttgaaggaggtttagatgttggtc

SEQ ID NO: 18709 - DNA, 252 bp, Homo sapiens
gtcctggcacacagctggccctcaatatctttgaatgaacttagtcaaaaccactttgtaaatataaataaaatggttcctctgctatatatgcaagccaagccgccatagtggaacatttctgagctccttgccattcaaagcatggtccaaggaacacccgcagcaggatcttctggaagcccactggaggtggaaactctctggccccttcccagaactgaatcagaatctgtattccaacctaagtga

SEQ ID NO: 18710 - DNA, 421 bp, Homo sapiens
ccgtgcttccagttttaaacctgacttgcagcgtcaccatcaggatgttaactttcttaagcctttttctgtggctacactgacactcattagtacgtgatgaaaggtaaaacatctcatacttgaaataattggtgggagttggcatccgtgagtcaggatggacactggtgttaaggctacagctgttactaagtcccctcatttagctgggcattcatcttttagttactaaactatgagaagactcaggggttccttggggaatggcaggaggtggggttggtgtaggacaagcactaggaagactctgggggcatctatttaacaaactaaatgaaaacaaacaaacaaacaaaacctcctttaccttcacaacacttctgacattctgagacccaagtgtacgtgtttttcataa

SEQ ID NO: 18711 - DNA, 1046 bp, Homo sapiens
gtttctagacgaagggcatataccagttaaactccgccattttgcctctcagtgttcaagcttgagcccacgcatccaactcctgagatcttactgggaagctgctgatcatcagtttcagggaagtcagcatggatcagccttacgttcatggcctccaggccctattctcctgcctcacagggaccggccaggatctctatccttacagcacgttggaatgtatatgctcctctccccacatcgccttagggagcaggcaggtgtcaggggcagcacaaggacggccaacaggacaggtgcataagtaagactgatacaatttgagggctcagctctgagaatactctaaacaggatccaaataacattgttgcctcctaaccagcaggtgggagctcaagagaaagactagacttgttccacattaaataagtaatagtattttttgccttgaacatcttgatcataatatcaattaaatgtgtggccctgattcaatagctaccatttattgagcatctattttgtgccagacttgctgctggtatttgatagtgcagtgcctgacaagtagacacactggcttaaatgtcattgttactggtattattgttacaatgatgttttaatcctcccaatgtaattaagcctttatcataaagatcataagatgttcactttacgttatttccttgtccttttcttcctccgtgcatgcttgcttgcacaagggaagtcactagtaattgattaacttcctaccctaacccccagggctgcctgcaagattgatgaactgtttttctttcaaagaacaatgatccttaggtcatgcagacctccttgatagcatctaggagtttgtttgggccgaggaactcaaacagttttgagtattgggggaatccatctcctgcatacctgctttgctcataaaagcccccagttatgttaaaaggcagattggatttgagaggctgcttctcctgccttcttgctttagccgagtcaaataaaccttcctctgcttctaagtgctgatgt

SEQ ID NO: 18712 - DNA, 714 bp, Homo sapiens
gtttctagacgaagggcatataccagttaaactccgccattttgcctctcagtgttcaagcttgagcccacgcatccaactcctgagatcttactgggaagctgctgatcatcagtttcaggaagacgggttgaagatccgagaggctgagtcacttccacaaagtaacacagctgattttaaatgcctgcattcagcatccctgcagcaggctccaggtggaattctaatgggaccagcctccagtccctggaccttagccgtggaaggagagaagaggacatctgcacctcctctcagagaaagcctgatgcctactaaaggacttgggtggtggacgcagtgaccctcagtctggagcttgttcactgaacattggagactatcatttgcgcagatggtcttgggcctctatgagcagcaggctgcaccccacagtgacctcctcattctactctgaggcatcttcatgaaagcagatgtccattgaaaagcacccaagtgcagtctcagctgatgaacttcagaggcgattgagacaaaggctctcggtcccctctgcccttggatggtgcctctggtatgcacttggcctctgtgtctttatttagactggtcacttcacaacccatcatgtcaccccacccctaaccgtgcccactctgggtcctcccctcaactgcctgacttcccactttgagctcagcaaaggca

SEQ ID NO: 18713 - DNA, 914 bp, Homo sapiens
acaaattcccctcatgtttttatatgtcattcagttagtcacatagcaacaactaaagtctggcaaaagcacatgctcactaagctaatcattcagctgtaatactagaaaaatcatgacaaccaaactgatttaaagagctaagataaatagcttggccccatcttcaaaaccagatttaaaaaacattctactgaattccttgtactaaataattcatagtatgaattttatcataacgaagttgataaggccttatggaatacaggctagtacttggaaatactttcattagtatgaattatttatggtaaggtcatttgtttttaaaagcctttggtctgtaacaagtactcaataacagaaaaatcacacacaaaaaatgaaaaacacatttaaataaaagaaaaatttaatggaattttcaaaattaacacatggttttacatttaatccttatagaaagacttatcaactgctcatatttattcatttaacaaatattttttgcatacctactctattacagacactgttctatgcattgattattcctgaactttcaaaatcctctcttatttacatactacagtttacaataaaccataaagtagttttaaaagctttcctaacaggcacggtacagtgcctcatgcctgtaatcctagaactttgggaagccacggtgggaggctcacttgagtctcagagtttgagaccagcctaaacaacacaatgagacccccatctgtacaaaaaattaaaatattagcccagtaaggtggttcacacctgtggtcctagctacttggtcagtaaggtgggaggatcacttgagcccaggaggttgaggctgcagtgagccatgatcctgccacaatgctccagcctgggtgacagagcaagaccctgtc

SEQ ID NO: 18714 - DNA, 671 bp, Homo sapiens
tggtttaggcatattttatatgtacatgtcagcatgtctaatcagtacatctgcacctttattataagtagaagagttaatttgctattttaggcacatcataccaactcttaaattggtcagatgaccccttgggaaatgtcctgaatccctcatttaagttttactttccaagttaggtgtttagttcattcttcatatgtgatagtgaaagtaaaagctttcctgactcgtaaggctgacattttcttgttagggaaagagactcgatagcaaggtaaactaacagtatttcccaaataaaggcacacaggagaaaataatgaatcaatagaatctaattaaaattactaccccagggaataaggagtattgaggatttattttattttgaattggttttaagtatggaataatcatctttacagttataaaaaaattagtgtttacaaaatgttgggcatttctgctttgacaaacaaacaggtaagtcccgtggccttcagaggcaggcagcagtagaaactttccaaaaagtaacaatttctctggatttaacatggaaatagaaaaatttaaagaataattaaattaaaaaaccatggtaaatgaaatgtggtgatgatatacagtttcggatgttaatgctagttgaaacttctaaaactagc

SEQ ID NO: 18715 - DNA, 944 bp, Homo sapiens
  misc_feature (827)..(827): n is a, c, g, or t
gatgagcattttttcatgtgtcttttgactgcataaatgtcttttgagaagtgtctgttcatatccttcgcccacttttgatggggttgttgtttttttcttgtaaattgtttgagttcattgtagattctggatattagccctttgtcagatgagtaggttgcgaaaattttctcccatttgtaggttgcctgttcactctgatggtagtttctttgctgtgcagaagctctttagtttaattagatcccattgtcaatttggcttcctcttgggagggtagacagacctcacaatatggaaagacgggacaacctatggaactatctgtgacttccatgtaccaagacaaggacgctatagctagggtagtgagacctagaagagagaaaccagaacaaagcagacaggctgtcctcttcctaattccatgccctgacatcagcccctattttttgcctttagctgtcccccagtttccaacccaatgggaccagagtctgacttccctttgccctttcacagtgtctcagcctccatctgccttgggctccgcctggctccccatctaactcttcccagttttttgtgtaaatggagcatattttatgtgcgaatattttagtaaccgtatgttctgcaagtaaacctgtgttaatacttgtcaacaactgcagagtttatgatacgaataattcttcctacaatgaagaaaaaaacacatttgtttgttttctaagaatgtttatttgtaaacatatgtattcactatattaatatgaatttcttacctggataaatgattttgggaaaaaaaaagggggggnaaaatcccgagggccagttacgaccggttgtaaagggccaagggaataaaagaggggggacgggggagggggtgggacttggggggaaccaaagggaaagtgggtggggtgaaaagt

SEQ ID NO: 18716 - DNA, 399 bp, Homo sapiens
  misc_feature (6)..(6): n is a, c, g, or t
  misc_feature (16)..(16): n is a, c, g, or t
  misc_feature (128)..(128): n is a, c, g, or t
  misc_feature (141)..(141): n is a, c, g, or t
tttccnggattaaaancctacatggataatgaaataaccagggagtttccattgtttaaagtgttgtcagcccttgaacaaggtttcctcataggcctatccttttgaagactgtgtcacatgtctantatgttgtaatcntcaagatttttatcagtgatttggatggagcatattttatgtgcgaatattttagtaaccgtatgttctgcaagtaaacctgtgttaatacttgtcaacaactgcagagtttatgatacgaataattcttcctacaatgaagaaaaaaacacatttgtttgttttctaagaatgtttatttgtaaacatatgtattcactatattaatatgaatttcttacctggcaataaaactgattatatgtgaggctgttggga

SEQ ID NO: 18717 - DNA, 2934 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcaaaaaaaaaagcacaacctgcacacaaacaaacacttttttgggcgcctatgggccctctgaaaaaggttcttcagaacaccatcgtttgggcgccgggggcccacataggctaagtcgaagccattctggacaaaagcgtggccccctaaggaaaaaccacggggcaaccgagccatcggggctggagattctcgacaccgcataaaaaacagaccccgcggggtgacaccaccagcgcttccgagaacaatcccgagagggaggtccagagagggaccatacggggagactacacaacagggaagtccaaaggagcacacgagcttaa

SEQ ID NO: 18718 - DNA, 3204 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18719 - DNA, 2472 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttaatacattatatgaaaatctagaccagagttattaatattcaaattactccttaaaagtgaaggcaattgttttctatagcagaattaaaataggcaag

SEQ ID NO: 18720 - DNA, 3040 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18721 - DNA, 2939 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18722 - DNA, 3000 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18723 - DNA, 2815 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcactacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18724 - DNA, 2679 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18725 - DNA, 2431 bp, Homo sapiens
gatggaaggttacagctaaatttatcaaataatttagttaatatccaattgaaagaaatctaattgaataaattagataaataagatatctaatctagatatctaatatggaattaaataaaaattggaagtagcaatagtttaatgacacacatttccctataacatgttcaacttaatagattcttcagaaaataacttaaaatgaagtggtaatatgcctcattctttcgtttcaaaatactgttttctttatttttagcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18726 - DNA, 2084 bp, Homo sapiens
cggacgcgtgggtcgacccacgcgtccgctccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18727 - DNA, 2454 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatgctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18728 - DNA, 996 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacccgagcgctaccaggtagcgctcgggttaaccatgtcattatgcttaaataacttaatgtca

SEQ ID NO: 18729 - DNA, 2908 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18730 - DNA, 2898 bp, Homo sapiens
ttggaggttcagtggtcgttttcgtgcctgcagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18731 - DNA, 2873 bp, Homo sapiens
taggctagtagaggcccggggtatcggccgagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18732 - DNA, 3117 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacaggtttctttagcaggactcactgagttgattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18733 - DNA, 2963 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcagcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatgatatctctggtgtatactgattgagaaaataattaaactgaagttaggggagggggaccttggtttcttgtatttttcagtgaatatcctaatgtaaatggtatatatatttttccaatgtgtttttcttagtaaaatgaagttggtacttctcagaacagcaacactagaaatacgtagacattgagaaaaagatcaagacttgataatgcattgaaatgtcctacaaattttattttctcatgtaaaaatgaatttagacacttgtaatatcatttaacattcaagtgattatatgacaatttc

SEQ ID NO: 18734 - DNA, 1754 bp, Homo sapiens
aaaaaaaaaaaaaaaaaaaaaaaaaaaaaaaaaaaaaaaaaagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctga

SEQ ID NO: 18735 - DNA, 1346 bp, Homo sapiens
gcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgccttcttcccctttcgcttcgcttctcctataccgtctttcctcttcgcactctccctcgtctccctcctgcctctcgccttctcttctctccagctcg

SEQ ID NO: 18736 - DNA, 3193 bp, Homo sapiens
tgggaacgcgttgagacgttcctctttcccgcttctccacctttacgcctgaaagaagactcccaaagattgctttcttctgggacgctgcttgaacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacttggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaacaaactttcatgaggagatccaatcactaatgcaacaaactctaatgagttccactgtgaagagag

SEQ ID NO: 18737 - DNA, 7600 bp, Homo sapiens
tgggaacgcgttgagacgttcctctttcccgcttctccacctttacgcctgaaagaagactcccaaagattgctttcttctgggacgctgcttgaacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacttggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggaggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttgccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcatcatgaaagtgtacatgcatatgcaagtgtgaattacgtggtatggatggttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaaaactctag

SEQ ID NO: 18738 - DNA, 2366 bp, Homo sapiens
atattattcagtgctaaaaagatatgagctatcaaactatgaaagggcatggaggattcaatcttaaatgcattatactaagtgaaagaagccagtctggaaaggctacatactttatgatttcaactctatgtcattgtagaaaaagcaaaactttggagacagtaaaaagatcagtggttatcagggacttcgtgggagggaaaaataggcagagcacagagcattcttagggcagtgaaattattctgtatgatttacaatggtgactatatgtcattgtacatttgtcaaggcccatagaacaggttttgaagttgatgtgatgttgacagtccccggggaggctgtgcctgcgtatagaaagcagcgtatgggaattctctgtactttccacttgattttgctctgagccggaaactgccctgaaaaataaagtctatatttaaaaaaatagtcgtagatactagacacagcatttttatcagcattttaaaatatactatatgcaaagataatattatatggtcaagaataactccttaatgtataaatttaaaagcaccatgaaatctcttaagaaacaatcagaagttttataaaattttaaaaaaggaaagtgaggaaaatgcctaaattaaacagtaaaacacacccagttattcaacaccaggtggcgactggactgggtctggatttttcttagcttgcctgactctgtgactgctgctctctgctttcttgggctccttctccctcaatcttcctgtttccagaacagatgctttttatgtcctcttgcctgtggtgacatcccaggatcccttccatctgcagttttttcttacctgttaaactttatgaggaggaaaggagaaaatattgattatttacctgttttgtaataggcattataatagatgcctgttgtaatctcttttaatcctcacaataacccacatgaaggagtgttattctccccattatatatattaataactaatgtgaaagatgatataatttgttgaaggccagtgaattgtaagtgatgtagtttggatataaaccttggtttcaaaattcaagacacggtaatctgtccattctgtaagaagcaagcacataagtgctaatgatgagtgtttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctgtcttttaaaaatgttcagcctacgtttatttttattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctactggcatctagagggtagagccgagggccgctgctaaacatcctaccctgcagaagacagccgcctcaacacaaaattatctagcacaaaacgccagtagctcaaggttgagaaatgctgaactagaggtgtgggcttattatcaggatagcatagcactggattcccattagaatccatagtgtcttcatagcactggattcccgttagaacatttcatgcagcctggtgcttcaattacctggcttccctttttgtagcattggcattagaatatagtttagtctgactacagaagggagaaaatacctatgtaacaaaataggtgaactgacagaattttggtaaaagagataaaacatagtagggtgataggtctacacattttaaaagccagtttgcagtcagtgttgaattttatagtttaattgtgcaatttaaactgtttgtttattctccatgagtgtttcacgttatgcctttgtgcctgcttcagtgctgggggacagaccttctaccctcctggttcatgttgcctctgtcttccattcctctttgctggaatgtgtagttgtggtaactgtgacaattcctaaggtttctgacagtttttgaacaccacaatggtgctgtaaattcctgtcttggccaggagatggacaccacattttgatggtttctcaaaccgtgtgtgaccttttcctggtttctctgttctgtcagtcatggcatggctggacagaattcagggacatctatcaggcctctcaggagcaattaaattattttcatgaaggcaatttgcagttgtaaacaatattgaagacactgtgtggcatttctcattagct

SEQ ID NO: 18739 - DNA, 1964 bp, Homo sapiens
ccctatcctcgaccatataatattatctttgcatatagtatatttcaaatttctgataaaaatgctgtgtctagtatctacgactacattttaaaatatactatatgcaaagataatattatatggtcaagaataactccttaatgtataaatttaaaagcaccatgaaatctcttaagaaacaatcagaagttttataaaattttaaaaaaggaaagtgaggaaaatgcctaaattaaacagtaaaacacacccagttattcaacaccaggtggcgactggactgggtctggatttttcttagcttgcctgactctgtgactgctgctctctgctttcttgggctccttctccctcaatcttcctgtttccagaacagatgctttttatgtcctcttgcctgtggtgacatcccaggatcccttccatctgcagttttttcttacctgttaaactttatgaggaggaaaggagaaaatattgattatttacctgttttgtaataggcattataatagatgcctgttgtaatctcttttaatcctcacaataacccacatgaaggagtgttattctccccattatatatattaataactaatgtgaaagatgatataatttgttgaaggccagtgaattgtaagtgatgtagtttggatataaaccttggtttcaaaattcaagacacggtaatctgtccattctgtaagaagcaagcacataagtgctaatgatgagtgtttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctgtcttttaaaaatgttcagcctacgtttatttttattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctactggcatctagagggtagagccgagggccgctgctaaacatcctaccctgcagaagacagccgcctcaacacaaaattatctagcacaaaacgccagtagctcaaggttgagaaatgctgaactagaggtgtgggcttattatcaggatagcatagcactggattcccattagaatccatagtgtcttcatagcactggattcccgttagaacatttcatgcagcctggtgcttcaattacctggcttccctttttgtagcattggcattagaatatagtttagtctgactacagaagggagaaaatacctatgtaacaaaataggtgaactgacagaattttggtaaaagagataaaacatagtagggtgataggtctacacattttaaaagccagtttgcagtcagtgttgaattttatagtttaattgtgcaatttaaactgtttgtttattctccatgagtgtttcacgttatgcctttgtgcctgcttcagtgctgggggacagaccttctaccctcctggttcatgttgcctctgtcttccattcctctttgctggaatgtgtagttgtggtaactgtgacaattcctaaggtttctgacagtttttgaacaccacaatggtgctgtaaattcctgtcttggccaggagatggacaccacattttgatggtttctcaaaccgtgtgtgaccttttcctggtttctctgttctgtcagtcatggcatggctggacagaattcagggacatctatcaggcctctcaggagcaattaaattattttcatgaaggcaatttgcagttgtaaacaatattgaagacactgtgtggcatttctcattagct

SEQ ID NO: 18740 - DNA, 447 bp, Homo sapiens
ttagccaggcgtggtggcacacacctatagtcccagagtagcggggactacaggtgtgcaccgccatgcccagctaatttttgtatttttagtagagacgaggtttcaccatgttggccaggctggtgtcgagctcctgacctcaagtgatccacctgcctcagcctcccaaagtgctgggattacaggcatgagccactgcgcccaacctcacagcatttaaattaattttaccctttgttttcactctttaaaatgttgctactagaaaatttaaaactacataagtgcctgtagtcccagctactcaggaggctgaggcaggaggaccccaggagtttgaaaccagcctaggcaacatagcaagaccacatctttaacaataaaataaaataacctatgtggctcctattacatttctatatttctgttggacaacacaaacat

SEQ ID NO: 18741 - DNA, 447 bp, Homo sapiens
gagaaaataagatggaaccagggttgaaggtgtaaattaagtgtacgccacaaagttgtacactcttgtaacctagaagtcccagttacttcagcccttgtgtttcactgttccctttaatatccaaagcaagaatccaaatatccattccaggtgaccacaggcaatccagtcttcctccaggttcctgtctctgagtgtttctggagctctgcagaaagcttccatctgccacagttctatcttgggggctacttccctcctcagcttgctgtcttactttgggcaagtcacttctggccatctcagatccagctttgtcctgactgccactacattcccatactccttcactccaaacattagggaattccacacttgaggtcggtttctggaatgtatatgactttactaaaagtaagggaactatcacaaagaagttgccac

SEQ ID NO: 18742 - DNA, 3146 bp, Homo sapiens
cgcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgagatgaaatcacaggtgctaatgtctcttcatgaaatgttcccagcagtacatgcagcagaaatggccgtccagcaaaatccacattcatgggagtcttggcagactttgggacgtgctcaacttggtttaggagagataatcctggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaactcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccc

SEQ ID NO: 18743 - DNA, 3014 bp, Homo sapiens
cgcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgagatgaaatcacaggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaactcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccc

SEQ ID NO: 18744 - DNA, 2932 bp, Homo sapiens
cgcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaaggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaactcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgcattttgaagattttcctattattttatgttgttagcttttgaaaaattagattgatctacttagtgtctttcttatatgaacttaatatatttaaagtaccttgcatggtgcctcacacatgaagtaatgccagctatttcagtaaatgctagctatttctatgaagaacttgagttagtttggagatatttaacctcaatttcctctgattttaaaaaaggagaactttttttgtaatcctttccttatctgaaagtaagaagtctctgattccagtattataggagagatagtgggatttttcttgacagggtctatagctcaagtcccaaagaggcaagactcaggatggaatgcatgtggccactaggccctgttataagaacctagtgtttcctctgtactggcatggtaggccaagttagtctctttcttacccagatataagacataaaatagtttagacataagacagaggagaaaaagaaacagtaagttatggagaaggaaggcagctcatttctgcaggcccc

SEQ ID NO: 18745 - DNA, 265 bp, Homo sapiens
gtcccggagaagagattggcggaggggaaagactgagtcgtctttcctttgcccgcttctgtggactgttcgaacgcccaggggtgggccaaacccgtttcttaggaaaccaggaatccagggaaggcaggtaggaatttgggcgtgataatttctgcttccagtgggaaagaatgtaaacacggggccttgggagccgttatcgggtaactggggctgcccggtcggcggtggaagctgaggaagaggaggaaaaagaggcgag

SEQ ID NO: 18746 - DNA, 657 bp, Homo sapiens
cgcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaaggtatgtatttaaagatttttttttatggagaagagcttacattttctagctcactgtccgtaatgggatgaagagttatgaatttgataaattcatgtttaaaaatctattctaggtgctaaattaatcaaagaaataaggtgtttcaaagtcacctgaaaaatgaaagtttgtaaaatagttttcaggatgcaatgaaagtttgtaaaatagttttcaggatgctaattatgtccctgctttgccatcatttttgttgtgcctaaagaagagtaaatgcta

SEQ ID NO: 18747 - DNA, 1040 bp, Homo sapiens
cttatgataggcattggttgattcagagagatatcacattcggtcatagccttctggaagtccagagggagagaagaaaaggtggggtcatgggcttaatgaatccaatgcaagagagcccagcctgtgtgctggacaattcttatctgactgaatgctgtgggaatccattagaagggagatgagtaagggtagggttacttggaggaggaggaacttgaactaggaggaggaagaagggcaaagaagaagtaattgagagttgttcttctaaggcatgcttaactatcagcacctcaccttcatcccagctcctcatcaagcgacaactcttgatcccgaggaaaacgggatccacagaatttgtataagaagggaaattagtgtttacttagtctagccctcatattttatggagggagaaattgagttctgtggagattaaataaataatacaagaattggaggtagagccagaactggaacccatctttctttttctcagttcatatccttctgcaaattcctctagagcagagaatacaatttttacttctttgagtgccctcaaaaatggagacattggccggggggcggtgactcacgcctgtaatcccagcacaagctaggaggctgaggcaggtggaatacttgagtccaggagttcgagactagcctgggcaacatagacctcatcttcattaaaataaaaaaaaaggagacatttatttatgggattactaagctggttcatagtagtgaccactattagataaggtggacacttgcatctcgcattctttaccattcccaccctaccttgttgttctttgactcagaggccaggtatcaagtgtcatttatcatcaagcttgcaatatttttctcatagtagcactaagagcaaagtgagatatttcttgaactcatgtctaccaataaagagaaaatgaaaggtagatggtaaatcagaattaggtttggttgcatttgatagaaaacctaactaattggcttaaagaggaaacattaatttatct

SEQ ID NO: 18748 - DNA, 494 bp, Homo sapiens
acacaagtgacccatttggattctgacaattttcacaaagttaagatgaggtcattagggtggtccctaatctaatatgactaatgactttatgaaaagaaaaatttggacacagagataacacacacagggcgaatgccatgtaaaaatgaaggcagaattctgggtgatgatgtgtttataagccaggaatgccaaaagggaccagcaagctgccagaacctaggagagaggctggtaacagattcttcccgacagcctcagaaggaaccaaccctgccgacacgctgatcttggacttccgcctccagagctgtgaggcagtaaatttctattatatgagacatccagtttatggaactttgttatgtcagccccaggactctaatgtgcaaagaccctgcagcacagggccaccaggtgacccaggcagttggagcataaggggcaggtgcctcccacccttgccacgctgataggagctggtcaggttg

SEQ ID NO: 18749 - DNA, 1033 bp, Homo sapiens
ttccacaatgtcacagtggttattcaagtgagtcctgttcagcgtgggaggaaataacacaagaggcaaagatcactctggtccaccttgtatattggctaccacagaacccaacacaagcagtaagttaaaatcatgaagctcctgacgtcagaggacatggctctgccatttgttaggtagggatcctgttaaaggctcagcttcctcatctggaaatggaaatataggccttgcctggtttgctgtaatgggtcgtgatgaggaccaaactacaaagagtggtacagatgttaattacaatgatttttcctatgccacccatggaaacaaaaatagcaagatagagaaggctaaatcccagttttttttgactgctattcagcaaagcctaggagactttcatgacacctggagaggcggccgtagtgtatgtgtaagagtaccggttccagagtggggctccccgagctcagccccaccacttaccaacagcggaccttgggccagatgctgaagccctttgtgccttggtttcctgacctattactgtggaaatgatgacagtaccctcctcatggcatcgtgagaattaaattagctaattcaggtgaagcatttagaagaggacctcctgacacttaataactgcttgatataaataatagcttctgctacagagtggccatgaagtctggacatgtagatattatattatcatgcatcataaggtagttgatctggtgtgagattccaacctcgtgtgagagaggagaagaccttcattacactaattcatgctggcccagcctccaggccaccccagatgtgaggtgctgttaacactgctctcagtagggacggggtttcgccatgttggccagcctggtctcgaactcctgacctcaggtgatccatccgcttcggcctcccaaagtggtgggatcacaggtgcaagccaccgtgcccaggctgctatcttattttcaagaatttgactcacgtctttctgaagaacatctatcacttagaa

SEQ ID NO: 18750 - DNA, 274 bp, Homo sapiens
gaggtacaagtcatgacacagcagccagagccggcttggaaattctgagattgactcctgcggcccagggccagtaactaccaacctggtgtcagacgagcaatcaatcgcaaaggaaaccttggggaagtatcccagcagagtccccataaacgagcagtttaagattggataagagattcctgtgatcagagaagctggggaacaaaggaaaccagttgttctccttattcttaggcaatatgcctgcaacctgctttcaaatggttcagcc

SEQ ID NO: 18751 - DNA, 897 bp, Homo sapiens
atttctttatgcaaaccaattaaaaaaaagtacccagactggtctgatgtgagctaatcttttgtctgtgtgtttctgcaatatcgtgtggtaaaaatcagtgttaaaattgatgattctgaggaataagatctaaagatatcaaagatttgaatgttactaacgagagggaaggaaagtattaatagaattttcagtgaatgacagtgaaaatattgtacttcaagtttatgaaaatccttttttttcttttgattattcaggatctgattttcatattcagatcagcaaactattggtctaattctgcctactgatttttgtaaacaaaattttattggaaaacagctgcagtttttcagttacaaacaaactgaaaaagtgtctgttgtttgtggctgtttccacattacaaaggctaagctgagtagttacaacagagaacatacggcctgtagagctgaaaaaatttcccgttttacccttcacataacctgtttgccaaactcttgatctaattaatgatccagctctcttgtgtaactttttgttttacttctgtcatttaagattgtatcccaaatctctggctgttgctgccattctaatatagtaaccttttatatagaaaattgccagtttaacagtcttatcctccagtaactggcaaattgttgtttagaataaacatgcaaaatctgcaattgtgttaaaaactaatataaaataattagactataaaaatgaatcttagctgggtatggtggcacacacctttagtcccagctactcaggtggctgaggtgggaggatcacttaagcccgggagttcagggttacactgagctatgattgtgccactgcacttgatcctggagcaagattctgccgcttaaa

SEQ ID NO: 18752 - DNA, 953 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtatttgtatcctttcgtctgatatacccattagcactgaaaattagacttcttatggataaagtgttgctaacttattgatcattcttggtatactagaagcatgtttattgcttcagaataagcactcctcaagcattagaagatgctctgtggagtgaatatctctatcaggaacagtatttgtatcctttcatctgatatacccattagcactgaaaattagacttcttatggataaagtgttgctaacttattgatcatttttggtatactagaagcatgtttattgcttcagaataagcactccccaagcattagaagatgctctgtggagtgaatatctctatcaggaacagtatttgtatcctttcatctgatatac

SEQ ID NO: 18753 - DNA, 2074 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18754 - DNA, 2533 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatccattgttctgtctgtaagaattttgaaacttggtaggcagaaagaccccacccttttctctttccaagataactaaaagaaaaaggtaaatcagagctttccatgttttcagtgagaattatcataactcaccaagaaagcagatcatggcaaataaactgtgaccttcagggagatttttcaagcccctttttgtcctgtttgtattaagaataatgccttacctttgtatctgcatttttatataattccattccaaccaggtatagcactctgaagaagacattatctattctccattatataaaccaaatcaaactttcatctacattcactagctatgtaataaataccttctaggagccagatacttgttgagagtctgggctacaaagaatcaggcaagactcctgatgtcaggtatttgagcataaaaagagcattgatggctaattagaa

SEQ ID NO: 18755 - DNA, 2168 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatgtagagatggggtttcatcatgttggccaggatggtctcgatcgcttgacctcatgatctgcccgcgatgacctcccgaagtgctgggattacaggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18756 - DNA, 1545 bp, Homo sapiens
gttcttatggttatagtggcaatttacctttacattttcaaaaagtattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18757 - DNA, 2019 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18758 - DNA, 1313 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctt

SEQ ID NO: 18759 - DNA, 1378 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttga

SEQ ID NO: 18760 - DNA, 1960 bp, Homo sapiens
agcagggggcaccggagccggagggccgcgggccggaggacgtcggggattcggtgtccccgggtgcctagaactccgactttctctgggaggaaaacaaggtggacgctgcacctgcgtcactgccctgcatcaccgtttggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18761 - DNA, 2174 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaaggtctcactctgtcatccaggtggaaatgtagtggtgtgatcatggctgactgcagccgtgatcctcctacctcagccttccaagaagttaggaccacggctggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18762 - DNA, 1748 bp, Homo sapiens
agctcatgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaaatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatc

SEQ ID NO: 18763 - DNA, 327 bp, Homo sapiens
cacgagtgcccatgtcaaccttgtttctatctcgcagaagctatgcttcaactcccaaagccttgcgcctggctgttgtttcctgcaggcctccatcaaaccttcctccctggccgtgaacaaatgtgactccatccgggaactccgaggactcgggaagagggatagagtcctgggctgagactcaggagacccatactccagtcccaacttcatcacggatttgctgtgtggctggacgttctgttctctctctgggcctcaatgtccttcttccaaaggaggcttttaataacaatagcagttccttgaacgcttactgtgtgc

SEQ ID NO: 18764 - DNA, 464 bp, Homo sapiens
cagctgccttcagagcgaagaccagtccagaagctctcagcctgctgctgttgatataaagtgaatcccctctcccgggttcagaagacaagagcgagacacacccctgcaaacctctttgaactcatgtctcatccaaaaatccatcagcatttatagctttttcaggagtttttagagcaacccccagcaggagccagtcaaaataactttggaagtgcatggttagattcttttcaggagacaaccttgatagcttattgttttttcttcaccttattgtgtgatgtttctcgccattcttttttttttttcattttacaacatgccattagattgccttaaagtctcctaaatatcccaatattagttacatatctgttccttgctactcctgcagatatttgaccctctgcctatcaattcaggtgaaagatctattacagattattataaaaagaaaa

SEQ ID NO: 18765 - DNA, 5445 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18766 - DNA, 784 bp, Homo sapiens
atatgatatatagaagtctcagattctcttttttgtttgtttaatgctttttccattggcagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtctttttggggaaagggaaccaacccaggtttttgatggggaaacctataaaaaaaaaggtccgtttgtaagatg

SEQ ID NO: 18767 - DNA, 5535 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18768 - DNA, 4294 bp, Homo sapiens
  misc_feature (4291)..(4291): n is a, c, g, or t
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaataaaaaaaaaaaaaatgaaaaattattaaataaaacatataaaaactattaaaataaaaaaaaaaaaaaaaaaattttataccctcttcccaaatacttattaatttctagtcacatttttcatcctcctcctattcctttcatatttccaatccccccctttaaacctccnttc

SEQ ID NO: 18769 - DNA, 5603 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18770 - DNA, 5387 bp, Homo sapiens
aggaacctgagggaattgcataaaacagacagactaggcggcgcatgccgaatagatgagaaccgacctgtaaggagagctagaacagagaatatgggccagggacgagagaaaacgcggcaggatagagaggaggacagctcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18771 - DNA, 4086 bp, Homo sapiens
atcagtattaactcatttcatcttcacaacagctccataagatggtaatcagtatccctcttttaaggatgaggaaactgaggcacagataagtaaactaacttgcccaaggttatatagccagcgagaggcaaagctgagactgatgggacgaagatgcgccatcttgctcccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18772 - DNA, 3433 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagc

SEQ ID NO: 18773 - DNA, 3930 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggctttta

SEQ ID NO: 18774 - DNA, 3001 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagt

SEQ ID NO: 18775 - DNA, 2910 bp, Homo sapiens
gagaaccacagccctgagagaatatttgaacaataaactggccaaaatacctttgtgttcctctactagactaaaaatttcctatttattagtggggtgattaattaatcaccaagaatttaatgaacatatatattagaaataccttaatgaaggagaaagtaagcacataagtaggtcatatttatatgagactactaggtttgtggcctttgttatgttgaacacgtagatgcttactaatttttatatttaaacttctactatgtaagataaattgtaaaggattagaacaaagcctcaaatgtaagaaagcaattaagaatgataaaatgtgtttggtttagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaa

SEQ ID NO: 18776 - DNA, 2994 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtctttttggggaaagggaaccaacccaggtttttgatggggaaacctataaaaaaaaaggtccgtttgtaagatg

SEQ ID NO: 18777 - DNA, 281 bp, Homo sapiens
attgtttcttaaaaacttaattataagaatcttgatttcttctctgaggtgtacatctgaatacattcaagagaaaagatataccattgactttttctagtttagtggttaagcatttatgtgctaagagttttcacatatccttgtttctactgatttccttttatttcgttttttctttccatttagagaaacctatgtagaacaagaacagggagaaaatgctaatgacaggaatgatagagcgattcgagtagcagcaaaatggtacaatgaacatt

SEQ ID NO: 18778 - DNA, 1932 bp, Homo sapiens
ctcccggatgttccgaggagcggaaagcaacacacgttgtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccagtgtctctccagaataagacattggcattcaaatgtctatatcttgttacttacaaaataaaaaacagataattagtggctttta

SEQ ID NO: 18779 - DNA, 1430 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18780 - DNA, 372 bp, Homo sapiens
atagaaaagcagttttcggagttaaaggagaagttgttcagggaacgactgagtcagctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18781 - DNA, 781 bp, Homo sapiens
aacggctaggtacgaggctgggtttggcaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggtgggggccgctgctgcccacgtgacctgccccacctcagggccccccaccctggcagcagctctgccatctgcaggcctgggagttctctgctcaccaaggcttccccatcttcagcccagagtccctggatcgcagttggctcacaagtcctcttgctcaaggcggccctgggaaaagggatttctagtctgtgtcagccccttcccgttctggggcaggttttgatggggtgggagggtggcggggaggcgggagagccgctgagctggccagcagtcaggagcatgggagctctgcctgggtggggcctatgctcccggtcctgggggcacagcactgaggcaacagccacaagccacagaggtggggggtggggcagggattgcaagctggaggtgggctctcaggggagcttttcttctcaccaccttataccaaccagtaggaatgttctcaaaaaattgtgcttactgtggacac

SEQ ID NO: 18782 - DNA, 1432 bp, Homo sapiens
ataggctagtggactggttatcggccgagggagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18783 - DNA, 1420 bp, Homo sapiens
ccggtttaatcggacgaggggggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18784 - DNA, 1487 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggacaaaaaaacaaaagaaaaaaagcagacacagacaaaaaaaaaaggggcgcaaaaacag

SEQ ID NO: 18785 - DNA, 1397 bp, Homo sapiens
caatagctagtagcaggctggtgttaatcggccgagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18786 - DNA, 1348 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatgacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18787 - DNA, 1261 bp, Homo sapiens
tggtgatctacaggatccttatggaatcctcctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18788 - DNA, 1390 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18789 - DNA, 1861 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggtgggggccgctgctgcccacgtgacctgccccacctcagggccccccaccctggcagcagctctgccatctgcaggcctgggagttctctgctcaccaaggcttccccatcttcagcccagagtccctggatcgcagttggctcacaagtcctcttgctcaaggcggccctgggaaaagggatttctagtctgtgtcagccccttcccgttctggggcaggttttgatggggtgggagggtggcggggaggcgggagagccgctgagctggccagcagtcaggagcatgggagctctgcctgggtggggcctatgctcccggtcctgggggcacagcactgaggcaacagccacaagccacagaggtggggggtggggcagggattgcaagctggaggtgggctctcaggggagcttttcttctcaccacgctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18790 - DNA, 1070 bp, Homo sapiens
tgggtttaagtgattctcatgcctcaacctgccaagtagctaagattacaagcctgtgtcacttacgcccagctattttttttttatttttgcctcgggatggtactcctccgccagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18791 - DNA, 914 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggacgacaaactgcacgccagaggcagctccaggtcttgggactccctgccgcccagcaagaggaagaaggcacctctggtttctggcccatacatcgtgtacatgcttcaagagatcgacatctggatctggaggcaagatgccaggccccccaggtgttctcagggcagttcttggtgtctgcttctcagattccaaggactggaattaaaacctttcctgggac

SEQ ID NO: 18792 - DNA, 1232 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18793 - DNA, 1160 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcaggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18794 - DNA, 739 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagtgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggac

SEQ ID NO: 18795 - DNA, 531 bp, Homo sapiens
gcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccaggtgttctcagggcagttcttggtgtctgcttctcagattccaaggactggaattaaaacctttcctgggac

SEQ ID NO: 18796 - DNA, 737 bp, Homo sapiens
agcccctacacacaagcacgtatgcacacacacagccccttcacacaagtacacgtgcacacagccccttcacacaagcacgcacgcatatgcacacacagcccctacacacaagcacacacgcacacacacagccccttcacacaagcatgtacgcgcacacacacacaggccctacacacaggcatgcatgcacacacacacatgcaggacgcacatgcacacatgcgggtacccaccactcctccccagagctagcccttactggcctcttgtcccagagatggatgatgaggactatgagcgacgccgcagcgagtgtgtcagtgagatgctggacctagagaagcagttctcggagctaaaggagaagtgagcgtggggacaccttgggctgggtctgctaggatctgggatgaggaggtggtgggcctggtactgggcaggcgtggttggtgcccaggaagtgcgcgcctaacaccgggcttgctgtggaatgggtgctgggtatgtgtttgcccaagagcgatgggtgagcaaatgggtgcacggctgcctttttaccacgcaggttgttcagggaacgactgagtcagctgcggttgcggctggaggaagtgggggctgagagagcccctgaatacacggagccccttggggggctgcagcggagcctcaagattcgcattcaggtggcagtctgtgggtggttctataccctcttcccatcccacgct

SEQ ID NO: 18797 - DNA, 457 bp, Homo sapiens
gaccagtagtgtttctgatttcagattttttcagattctggaatatttttgttacacttactggttgagcatcccagatccgaaaatctgaaatgctccaggagcatttcctttaagcatcatgttggtgctcaacaagttttagattatggagcattttggattttggattttcagatttgggatgttcatccttcattagtgatgttaagtttgatgataagagcactttggtcaacatattttaaaaatcaattccaaatcctatgacttgatccttgtacttaagtattcatagtgttcagaaaatgctatattttacacaaagaaaggataaatgcttgaggtgatgaataccccacttaccctagtacatattatatgcctataaaatacctcatatgccccataaatatctactgtgtacccacaaaaattaaaaatacaaattttttaa

SEQ ID NO: 18798 - DNA, 579 bp, Homo sapiens
gatctcggctcactggaagctccgcctcccaggttcacaccattctcccgcctcagcctcccccagtagctggggactacaggtgcatgccatcacacctggctaatttttttctgtatttttagtagaggcggggtttcaccgtgttaaccaggatcatctgggtctcccgacctcgtgatccacccgccttggcctccaaaagtgctgggattaaaggcttaaaccaccgtgcctggccttaggataatcaaatttttaattttataaggtaatactaattactttctaaattagttgtaccaatttatgtacttacaagcagaatgtaagattttccactggcccacaccttttccaatattatagaaatttagacttcctaagtttagaaacatgtacaaaactttttatattattgtgttaataatagcaaaaatctaaacataacctaaatgtctatcaacaataaaatgaataagttgcagttatgatcatacaataggctcttatgcagctccacctatcaatttagataaacctcagaaaacataataatgtgtgaaagaagcaagtcac

SEQ ID NO: 18799 - DNA, 488 bp, Homo sapiens
aatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaata

SEQ ID NO: 18800 - DNA, 999 bp, Homo sapiens
ggtgcttgatgaaaagggaactctaaaataaaatgctacaagtcagacaatcccagtcataggaaccaatacctctcaaagacagaattcctaatatgtaataagcagttgataaatatttctggaatgaacacagtgttagttatgactccctgcttttcagatatcccctgtcacagttttttagtgctttctagaagcagtttatcatcttaattcaagtatattcaaacattcaaactactaagcatctgccatgtacaagatgctcttttaagccaggcatagtggctcatgtctataatcccagcactcagaaggctgagatggaaagatcacttgaggccgggagttggagaccagcctgggcaacatagcaagactcttgtctctaaaaaaaataataaaaataataatctgggtgcagcagcatgcacctttagtcccagctattcaggaggctgaggcagaaggatcactgaaacccaggagtttgagggttcagtgaactatcactgcaccactgcacaccagcctgggtgacagagcaagatcccatctcttaaaaaaaaaaaaaaaaaaagatactcttcctgattcagagaggaacacccaagcagagatctcatgccctaatccccactaggggatgccagaattgaaaatataggacatgtagttaaatttgaattggacgtaacaatgaatactcttgtaggatacatacatcccaaatgttgtagggacgtatgtataccacatactagggacatacatataccccttataagggatagacatatataaatgtgggattaagctgggcttggtggcatgcacctgtagtctcagctacttgggaggttcagatgggaggatctcttgaggccataagtttgaggtcagcctagacaacagcaagaccccatctaaaaaaaaagtagggggtgttaaatactataaaatactaaaataataataccaagttctaaaaaaaaa

SEQ ID NO: 18801 - DNA, 150 bp, Homo sapiens
ttttttggtgtgtggtggggggcgggttgtctgaatcacctgttatttgtactatttattgatagtaaactgtattttcttaaatgtaaaagaaactgtattaatttgatgacactagtactgaagcaataatcaaatacttgcttatct

SEQ ID NO: 18802 - DNA, 321 bp, Homo sapiens
gtttggtcagagaaaatgactggtctgttgctatcagcctcagttactatgttttattttttatttttcttactagtgcattacagttaaatagaattttattgaagaagttattgggctgaaggcagatcactgtaaagcagcccccatcactggcatctggtctcagtgtgataaatgctcaagaggagaagaaccttcacagggccaggaagtgatgatgtaggttccctacctgccggaaggcgccacatctctgcccgcaaaagcagatgtggaagttgcccctctgttctccagtctctctcttagaagcagtta

SEQ ID NO: 18803 - DNA, 346 bp, Homo sapiens
cagctttgatttttatgaagccatagttaccatgaggtgcatctgaacactcccagagcctgcttgccatggggaaagggcctgtaatttcatagcccatttctgtcccaaccttagttgatgactttgggaataggttgagcttttcagttgaagatcctgaaatcacaaatgacttgaacccaaatgctccctgtttgcatgggctcaccaccataatcctaaaaggaactcctattttctggaagccttttctggatcccccaacctaccttgacccagaacacccccctttggtgctgccatagcctcccacatatacgtccagctgtgccacgttctgatt

SEQ ID NO: 18804 - DNA, 896 bp, Homo sapiens
aagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtcagtctattttgaatctgaaatccatctcaaagacaggccaagagcttattagtggacttaactggattctgctggcccaagcgcagtaaagtcaaacaaccatatcgaggttttgcactggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaag

SEQ ID NO: 18805 - DNA, 436 bp, Homo sapiens
tgtttcaatttactcatctgtaaaatggccataataatagtatctactttgtattctttatgagttgaaatttacaaagcatatagaataatgcctggggtatagcaattgtttaataagtgtctgtgaaacaaaaattttgaaaaacaaatgaatgggtcagaaattctaaagtgttttctgtagggtttatgccattttgtcttaatgatcagcctctataaccttaataccttttttaaaatgtttgttgtaacaatcagatattgtatatgaaagcgcttggcatagaatttgatgtgtgcatctctaggatggttgtaaccagatttgtttctagataattataaatgcttgctgtacttgggcttgaaatttgttatatcagatccatgtcaaccctatttgaagatcatataaaaaaatctcagccatt

SEQ ID NO: 18806 - DNA, 362 bp, Homo sapiens
gatacagcactgcacacaccagaacgcagaagcccagggcagatgactctccaggcaccagcagatacagcattgcacacaccaggacgcagaagcccagcgcagatgactctccaggcaccagcagatacagcactgcacacaccaggacgcagaagcccagggaagatgactccagacaccagcagatacagcattgcacacaccaggacgcggaagcccagggcagatgactctccaggcaccagcagatacagcactgcacacaccagaacgcagaagcccagggcagatgactctccaggcaccagcaggtacagcactgcacacacgaggatgcggaagcccagggcagatgactc

SEQ ID NO: 18807 - DNA, 251 bp, Homo sapiens
cagccttcctcaggaaaggccgagcgagatagcacgagcacagcagggctgccatgagcacggttccaaggccgcgaccccctggcctgctccccaccctcagaggctgggaggggccgcggcctcttccaaagttgtctccagcaggaagcagggcactgaagacaaggatgggcctaggtgaccctgagttcgcatcctatgactgctttggaacagaccctgcctggatgggaagaggggggcccatg

SEQ ID NO: 18808 - DNA, 406 bp, Homo sapiens
ttatttcacttagcctaatgcccctcaagattccatcccatgtggtaaccgtaagtcagaatcaccctccctttttgaaggctgaatcatgcctcccattgtgtaccgtacgcccattttgccttatccattccctcccatcggtgggtgccttggccttgccttcccacattttagcctattgtgaatgatgctgcctctgaacatcagtgtacacataccttgttttgagaccctgctttcaaatttgttggggtatatagccagaagtgaaattagtgcatcttaagggtgattctgtttaaattgtttgaggaaccgcaatactgttttccacagcagctatggaaggatggaaaaattgtatgatctatgaattatatctaagtaaaactgtaaaaaaaaa

SEQ ID NO: 18809 - DNA, 183 bp, Homo sapiens
cccgctcgcaggtatgggcagaataggaagcggactgtgcatcagcaaggaggagccaggacttggtgatacctgatgatcattaaacctacggatttacgccgatgataaagaccattgaacattatggcgaggcgcggtggctcacgcctgtaatcccagcactctgggaggctgaggggg

SEQ ID NO: 18810 - DNA, 442 bp, Homo sapiens
cacttctgacagcagcagcaggagactctaacctctgtcttgctcagatgctctccatggctcttttctcttgcccacactgatgagccccaggctgctggtgtgactgtcctaaagagaggcccatgtggcaaggaactgagggatgcttctagccaacagcaagtgagaaacaaaggccattaatccaacagcctgaaaggcatgaatcctgtgaacaaccgggccagagactttagaaacagaacctgagatggccacagccccgaccaacaccttgactgcagcttccggaggagccctgagacacagctagtcatgattgggtttttgaaccatagaaactgggagataataaatattataatccactcaattttggagaaggtggttatgtagcaacagataattaaatactggctaattgtccactgattgcata

SEQ ID NO: 18811 - DNA, 377 bp, Homo sapiens
gccttccattcctgagtacatatataaaaataaatgcaaccacagcacatcagtagacttttaaaaatacatgtcccttcttttttaaagcaagagatatttttatctcaacccagcatggataatcggaataaaattagagcatgtatggaattgaattaacctgtggattaaactcatccatttgggagatcatggttattactgatttaatctaaacatcagtgctagccgtgtgcatatgtggaactcagtgctgtatgaatgcgaagaatacaggatgccttttcagtcttcaatttggaaacttcatcatgataacactgattatcaggtaaactcaaacagtacaagacatgctttctctcatcttgcaa

SEQ ID NO: 18812 - DNA, 444 bp, Homo sapiens
gcaatgtgtaagggttccagtttctccatatcctccatgtccttatttttctgtctctgattatggccatccttgtgggtctgaagtggtttctcagcatgtatttgatttcgatttccctaatgactaacagtgttgagcatctttttatgtgtttgttagtcatttttatatcttctttaaagagatatctattcaaatcctttgcctacttttaacccaggttatttgtcgttttattgttgaattgccagaattccttattctgaatacaattttttttttttttttgagatggtgtctcgctctgttgcccaggctggagtgcagtgacacaattgtggctcactgcaacctccgcctctggggttcaagctattctcctgcctcagcctcctgagtagctgggattacaggtgcacgccaccatgcctggctaatttt

SEQ ID NO: 18813 - DNA, 463 bp, Homo sapiens
tccctgctagcaaccctagtctggtacctgaataagcagcatcaagaggcatcacacacactgatgagtgtggtagctcaaaatacagagccctgattccacatacatgagctcccatgtgtggctggggctctgctgggtcctgggggcaggaggaggatggagaggcaggccctaccatggaggaggttgtgatctaggggcaggctcctaaccagttaacatgtgcacagtttggcaagtctctcacagaagtctatagcatgtgggggaacccagtggaagaagtgatcgagctctaggatgaggaggagactggggagaacttcagagagcccttagaacttgaactgggactgggcacagcagctcacacctgtaatcccaacactttgggaggccgaggcaggaggatcgcttgagcccagaaattgaagaccagcctggccaacatagtgggacc

SEQ ID NO: 18814 - DNA, 354 bp, Homo sapiens
acctgccaaagcgtagtacccaaggacccagatgcttggttattggtgatcctgctttaactcttagatgaatgatttgatgtctgtaaaattgtaccttccttttaaacttaatttttatcttacagcagcagccagtaaggaggagaaggggagagagctcatttgatattaacaacattgtcatcccaatgtctgttgctgcaacaactcgcgtagagaaactgcaatacaaggaaatccttacgcccaggtagaagctcagaatagttggctcctctgccccattcttcctgctattgccctgttttccctcttctcttctgaccaagagttgggccctagtctttggtt

SEQ ID NO: 18815 - DNA, 3700 bp, Homo sapiens
gttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccagtaagtgtcagggagccgggaagtcccccagagtatcagtgacttttcattccttttatattctcaaatttgtagtttgcatgcatgttggggttgggagaggcagttgaccgataaaaaattcagctcacagtgactgcttctgcttgtcttggatgctctcagatggacttcgggagctattctagacaccatggatcttggagcaagacccaaaatgctcagtgaacagccagcaatggcatggcattgagttcatctacgggcaggtgtcttctgtatcctggtgacatgtttctctggttctgggctccctgtgcctatcctagccattgtgcaaattactagaaacttcagtcctgaaggactgtcctgctgccctgggtatacggcgttggcctagagagaactcgagagcttggaactcgaataagaaaatatttgagaggacatatttcacagctctttttctgttcccctcttcagagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaagcagttgatgcactttctctctagtgaagtcagctgtatgatattttctatctgttctaagttgctctttaaaggagattttgcttctc

SEQ ID NO: 18816 - DNA, 2823 bp, Homo sapiens
acctgccaaagcgtagtacccaaggacccagatgcttggttattggtgatcctgctttaactcttagatgaatgatttgatgtctgtaaaattgtaccttccttttaaacttaatttttatcttacagcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaagcagttgatgcactttctctctagtgaagtcagctgtatgatattttctatctgttctaagttgctctttaaaggagattttgcttctc

SEQ ID NO: 18817 - DNA, 3355 bp, Homo sapiens
  misc_feature (2472)..(2472): n is a, c, g, or t
  misc_feature (2492)..(2492): n is a, c, g, or t
  misc_feature (2496)..(2496): n is a, c, g, or t
  misc_feature (2499)..(2499): n is a, c, g, or t
  misc_feature (2502)..(2502): n is a, c, g, or t
  misc_feature (2508)..(2508): n is a, c, g, or t
  misc_feature (2514)..(2514): n is a, c, g, or t
  misc_feature (2522)..(2522): n is a, c, g, or t
  misc_feature (2536)..(2536): n is a, c, g, or t
  misc_feature (2539)..(2539): n is a, c, g, or t
gttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacatnagtgatttttttttctgttngcangtnaangggttngtcatngtttcttnaaaaaaaaatacantantgccccatatccctatgcataaagtgcttcttctatttataaggttgaaaattctgaataacccttttagcattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaagcagttgatgcactttctctctagtgaagtcagctgtatgatattttctatctgttctaagttgctctttaaaggagattttgcttctc

SEQ ID NO: 18818 - DNA, 451 bp, Homo sapiens
ggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacaggtaagggacgcagcctttgggtggggttggcatggttgggggatggaaccaggaaggggcagcatctgctgaagagggacctagccatcccctcccccttttgaagggacaaagggctgcacttaaattgatctcctcaacgttcagtggaactgtattgatcactgctaaatgatcaatacagttgtctgggtataccctaggag

SEQ ID NO: 18819 - DNA, 398 bp, Homo sapiens
tgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaa

SEQ ID NO: 18820 - DNA, 3214 bp, Homo sapiens
gttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaagcagttgatgcactttctctctagtgaagtcagctgtatgatattttctatctgttctaagttgctctttaaaggagattttgcttctc

SEQ ID NO: 18821 - DNA, 3161 bp, Homo sapiens
gttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaagcagttgatgcactttctctctagtgaagtcagctgtatgatattttctatctgttctaagttgctctttaaaggagattttgcttctc

SEQ ID NO: 18822 - DNA, 1481 bp, Homo sapiens
gttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtgatggggcaggcttgggtccccagggcctgtggagagagggtggacagggagtttgggccctacttgagtccatggaattgctactgcctcttggttgctcatcatactcatctactggcagtggcaaatagctcagaatttccttggtgtttgttggaactagtggagatatatggaactagtggagatataaggagccaagtgctagatccttgctgagaagtcactatgtaattctgaattcccatgatctgtggcatttggaagacagttggggggtcatggtgattcaacccggggagcttggaaggcctcgctacaagttaaccttcctttggacagtggctttgtgatgccacttgaagaaactgcccccccttaacgtccatcactaccctgtctccatttattgttaacagtggcagaaaccctcgggattctcaagtagaaagttttgggagctcttacttttacttttttttctttgactacagttttcaaagtctacacgaatctccctaacctcctgaattcactaggcactttgctatggactcacctggcattgttcagccatgcttttttcttgggatggtaaatgttgtatacctacccctccagagaatagtgggaagaaatgggagttgctggatcctaaggaaa

SEQ ID NO: 18823 - DNA, 549 bp, Homo sapiens
gctaatagatgactattagattttataaaatatgtttgttttggctattaaatgactattagattttataaaatatatgtttacttactaccttgttcccaaagggatttaaggcatttagttagcatctttctttaggaattcatcagtagtaacaaatgagcagtgctagttgaaattctaaaataaaaactcatattcctctaggtaattgctttttaacctttttaggggtctttcctgagaccagactgcattcatctgaaaacaaacctgtagttaggacaatccatgagtaaagaaggcctcatatttagaatgtcatagcttctcagaatctgctttgaaattgaaagtcaacatagctccttctgctgtggtgcaaatgtctagagcctaaacatctctaaaatggaaactgggctgggtgtggtggctcatgcctgaaatcccagcactttgggaagctgaggcagacagaaggattgcttgagcccaggagttggagaccagcctgggcaacatgagacaccatctctacaaaaaaaa

SEQ ID NO: 18824 - DNA, 327 bp, Homo sapiens
cctggcaaaaccctggcaggtaagttagtagcaggtcaatatcccacagcaaagaaacaaggaccaaaaaatgactgacttttgacttttcacttcttttttttttgtatgtacccatcagagtttatataaccttttgctcccttctgtcactttgaaaacaagcaaactaagccttcaaacttcagacttcaaactcaacctacagtcattcccatgttccttctggttaacaatttacaaatgacatatttaaatgttagcattttgtagagagaatcaggagaatcagggttttttttttttaaaatctggtacaattaggtg

SEQ ID NO: 18825 - DNA, 515 bp, Homo sapiens
gatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatataggtttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacag

SEQ ID NO: 18826 - DNA, 825 bp, Homo sapiens
gtgacaggggaaacaggcagaacaagtcagggcaaaggaccccagcatgaagagttgtggaggtggaggtggggaagcagcctcacatctcacacttccttccttctcttaaatgtgagcagctgactccaagccttgtggaaactctagaaggtagaaccagccatctggggaagctggccttacagatgccccgtctggcatagtggaggttcctgtgctctgagaacgcagtgtgaatctagacatccactgcagcctgggaagagctgtgttttcttcaaaagtctttaactttcacagtcacccctctaaagaaatgttctctgattgaaggcatgcttctattcctactttattgtgtttcatgcattctgccagagtaattacttttcataccaattcttggatgcagagaaatctctggtagtctaaggggatttcgatccaagtaaagctactatctcctattccatccagacttttccgtctgcctccattctctcagtcacatacctagaagcaagccagaaagcctgtccaaccaaaatcactctccaaagcccaagcactttattgttctccctgtctgttatcgagccaaggtgtatttggcctcattttatgccattagttgtctggctttcatggctctgcaccacattacagtcagagcaggaaggccagcagtggagatagaattatggcagaaacccagagtagaggcctctgctggtgagggagcctgcagcactctccacgctggtgggtcctagcatgcccaacagacccccatcccttcccatcagccttgggccttgagtc

SEQ ID NO: 18827 - DNA, 356 bp, Homo sapiens
aataatttctgtgagctcagaaggggacagcatctgcctttaggcatgacagttcagccaactctgggtgcccttgagggtttctctttcaatcccagaaatgctgataactcagctgggctggggcaggatttggcatgataggctggctctgaaccccctcctaagagaccaagagaggaagtgatggaattggttggtcccatttcaactctatgctgattctcagggttctcatggcttccctaagagagccacctaaactgctcgggggtgaaaaatcctcttgtattgaagtgccaagctgcctgcagcagtgcatgatggacattttttttttctttttaaaacacacc

SEQ ID NO: 18828 - DNA, 548 bp, Homo sapiens
tgccacccctaagacagcaagaccaaccctcctcttcctcctcttcctcagtctattcagtgtgaagacaaagatgaagactcttatgatgatccaccttcacataatgactagcattgagataatgaagagcatcccagaggaaacaccatgggagggaatacccagccacaacccatcttcgaacctgttgcgatgctgcagaaatcagaggagctggccagttaatgctgagaatttcatcaggggctaacagcatgaaagctttcaaattattaatattttgattcatggcacatttatgggtctagtccatcctaagaacattataaagagacatttccttggatctgtctgtgtttctgaaactgattcaataccagatagaagttcgcagaggtaagctgaatgatggactgggatttttagggtcttcaatgtgtataacttcacaaaaaatatgcacagagtatggaaaaagtaggtttgattggaaaaaatctatacgacgaggaaacagcctgtcaaaaactcatatgctcataata

SEQ ID NO: 18829 - DNA, 343 bp, Homo sapiens
attggtagttttatccatatgcacattatgggacagttaggttggtacctggaagtgtaattttaaagaagcacttaggccaggcacggtggctcacgcctgtcatcccagcacttgggaggccaaggtaagaggattgcttgagcccagcctaagcaacatagcaagactctgtcttaatgaaaaaaacaattgttttaaattagccaggctcacacctgtagtcccagctattcgggagactgaggtgagaggatggcttgagccaaggaggttgaggctgcagtgagtcgtgatcacaccactgcactccagcctgtgtgacagagcaagaccatgtctc

SEQ ID NO: 18830 - DNA, 438 bp, Homo sapiens
ccgcgtgggtggtgcatgtgcacctgagcaagttggaagaggaggtttggcatctggatgtttggcggctcacttctggtcaagggagttgggcgcgggtgccctaagcccacccctgtacattcacacgtggggtttctagatgccagatcctgaactgctggtaggtcggagctttttgcctctgacacgctggctttggcctgacagaggttgtctggagtcaacagcagggctgggtctctccagggacttcaccaggctccttcccagggcgggtctgggaattctgggagcagtgggagctccaggcagttctggcccatgggtgcctgcagaggtaggaagagtgcttggaggccccacctctgcctgaagaagaaccgaggacactgttcctcatccctgctttcttttctctcgtcttcactggggact

SEQ ID NO: 18831 - DNA, 493 bp, Homo sapiens
gaatactaaacattactggccaagtaaattgctttctgtataagcgttctcttttttttttttgaagtttgccccagtgtgaaagtctctctcagaagattggtaactaatgggtaatacacaacattccaagatagattctggtatcttgagccaacatatcaggagaatggtacagaaaaactgaacattaccagcccctctaccttagctaactgcaaaatgaacagcttccaaggacttgctgctactctcccacaaaatgaaaagtctatgtatcaagatgtagaatagtacagctaagcacaaggctcctccccagtcaaagaggagcagagagtgaagatcactatcagtaaaagcgctggcctagagttccatcactaaactgatatgtaacccaaggcaggtcttctttctttgagtttcagtctcatcatctttgaagtgagaataacagagcataaaagtcaaacttgaaccaaaaaaaaaa

SEQ ID NO: 18832 - DNA, 813 bp, Homo sapiens
gaatactaaacattactggccaagtaaattgctttctgtataagcgttctcttttttttttttgaagtttgccccagtgtgaaagtctctctgtaagtcaaaaccttagcattattttaatgtactgtgctgtatttaataatcttatgcttcagacattagtctgttaccatgggaatgacagcagcataaatacaggattatggctatcaagcaggagaaaagaaattatgaataagcctcgttatgttcaataattagcagctacatggaaaaaaacaaaaccatgaatttaggttgatgcatttatctcagtgtttgaatacaactctgagtgtgttattgctttaaaatgagattctaacaaactgccaaaaacttcttgactagcagttgttactcagtgctataatttaaaaattcatcctgtccatctcttttttctcctatttatattcttccccagcagaagattggtaactaatgggtaatacacaacattccaagatagattctggtatcttgagccaacatatcaggagaatggtacagaaaaactgaacattaccagcccctctaccttagctaactgcaaaatgaacagcttccaaggacttgctgctactctcccacaaaatgaaaagtctatgtatcaagatgtagaatagtacagctaagcacaaggctcctccccagtcaaagaggagcagagagtgaagatcactatcagtcttctttctttgagtttcagtctcatcatctttgaagtgagaataacagagcataaaagtcaaacttgaaccaaaaaaaaaa

SEQ ID NO: 18833 - DNA, 445 bp, Homo sapiens
gggctggaatcaaacactgggaactctgaatgtgtttgctctagaaaaagacttgaagttagtgaaagtgcatcttagagaacatgttgtaggggccaagtgaatgtcaattaaagttcactacagaatttctgacttcaaaaatgattttcaaatttgcagatgtgctcttgtatttcaaaactttttcttagtcactgaaccctgtttctgttcctctgaatgaaggatcacacaaagagcatagtgacatgtcatggtagatcagctcacacaggatagggactgtgtttcacttgtgtgatttctcatccagcacacaggtgcactagttgggcacagagttagtgctctttgaaaagatgtgaggacaacaaaacctgcttatcacctacgcagcctctgggactttggcaggtgatagtaataaatagcaatacaagag

SEQ ID NO: 18834 - DNA, 478 bp, Homo sapiens
aaaagcagatccactgatatggatacagcagtaccatttaaaagtcaccacaaattacctaaaatacactggggtttcataaaacaccatctatccatcacaaataatgtttttaggaagcatgttcaccatttattttctaaagaaaaagttcttacacaaaatctctggttgacaagctgttattttcaaggctgcagggatttctagagaagcatgccttatgtagattagctcattttttatgactccaagcacttaagtatttaaataatgcaaaagagcaacagctaattaattgtgaaagttgtggcaaagcactatctatatattgataaatgtctaatgctctatttaggtgcctttaaaaaaggatattgttgccattaaatattttcactctcatatttccccactataacaggacattgttgagagtcttccttatgaatacacccaagaattagaaatgcataca

SEQ ID NO: 18835 - DNA, 355 bp, Homo sapiens
gccgagggtcccgccagtctcaacccgaccccgcagccggcactcctgcggcgcgcgcgttccgagctcttggggccagtgacgccggcgcccttcctgcaactccgggccgcttcttgaacctgacaacctctagggaggcgaaagggagagtggatttggagaggagcaaattccgtatatttaaaataacgtttttctcctagccttacaaaaataacattgcggccaacctatacccagcatccagccacctagagataatcactcttcagtctccgccatccagattatgtctacgtgttttctcttttcaccagaaactgttctgtaaacagctttccccccatttagt

SEQ ID NO: 18836 - DNA, 409 bp, Homo sapiens
caacttacaccatgaacatctttccatatcaggtcatatggaactttttcattctttttaacaattgcagaatattgtgggaagtagtttaatttactcagctagtcttctaatgatggacatttggcttgtttacaatttccattctttcacaaagcctgctgcaacaaataacattattcatatggcattttgtttaagtgtgagtatatatgtaggataaatttctagaaagtagacttgctggattaaaagttatgtacattttaaattttgatagatattgccaaatttccatgcaaaggataaatttctttgtgtagaattgcttggttgcatggtgtatgcatttcatctttcagaaatgttgtatcagtttatattcctgggcaatatgggcaaacaagat

SEQ ID NO: 18837 - DNA, 298 bp, Homo sapiens
ggggagccacttctactttcagcccctccctggaatagtggagttgggaggatggggagacagctaaccaacttcattacccaaactgtattgcacttttagttccctagttttctaggcgagcttcatttggagaaggatgatgatatctaggcataacctagcccatgaggaacctagttaggaaagacaactgacatttattgaattccatgtactagtcctttccacctgtcatattttaattatagaaatcagtcgccaaaagaatcttggggattttctatctgactggcct

SEQ ID NO: 18838 - DNA, 396 bp, Homo sapiens
tccaaaatgagcataacttagaactcagagctgaaattgcatgttcatgctcagcctgaaagtggatggaggtgctgaggtaaggactgggcttccttggaaagaccttagggaggaccacaggctcatgggagccaggattggccttggttataggaacagtgttcaaaacatgcccacgcagcatcctcacttctcagaaacagaagagccttcctaggaatcaaacagcctggccacattttatcttgcgaaactatttggcctaggttctccatctccctcacctcctacatctaattgattctctcctcattgtagaaattccaggagcccctttctgctttcccttctttttacttcatatcttaaactttgcagtaacgttgccaatct

SEQ ID NO: 18839 - DNA, 433 bp, Homo sapiens
gtgtgtaggcctgggttcctcacctgtggatggacgctccttacctcattggcttgttgtgaagatcgaatgagtctgtgaggtcagtgaagcacttacacttagtaaattctcaataaatattcactgtgatgttttttattagaaacactgacacattactgagtgcatgtgctctgcacgtgtgcatgacaatgaggaaatttccctttaattcctgaagtgctgggtgatgatctatacccaggataatttttctagtaaatcagcttattggggatgcctatggataaagcccttcacttttaaggtattccctttaatttaacaataagacataaaacattgaagtatacaaaatgaacggctatggttaatggattacctgcaaataaatgacacctgtccaaatctggcttcaataataagggaa

SEQ ID NO: 18840 - DNA, 334 bp, Homo sapiens
gaatatgtgaatctggaaggtcgtgccatagtgccagactttctggatctttatttaattcttaatgttgaagggcttgatatctatatttatatcttcaattatggttatagtcatatagatatacttgtctctactgatctcttacacctttatgtgattgtaaaagagaacgagagtgattacgcattcatttattcagcaagtttttatttcacacttactaatttcaagacctcgagccacagtctatggagctcctacccttaagaagcttatgaatttttgaaatacattatataagtatataaataaataaaaatataggaaatta

SEQ ID NO: 18841 - DNA, 455 bp, Homo sapiens
gccttgaacagaacaaatgccctcttaacccggttcctttggcggtatgtacgtcctgatacctaaacaacgtttcctttaatttattttttgggtgtgtgccaaggcctgtagaaaaaggctgagcagaggttctcttggagttgttttatctgctgagacttgccaaattagaatttgatggctttgatttctgggacttcctgatcatttttgaggaggaggagttcctaactaagctggagggcacatactttctccacatgagtggggcacccatgatgtcagcgaggacagtgtcagatagatgcacagcccatcacccagaaactaaggtcttgtaagaataccttagtgaattgtgccagatggaataaattctgaatcctttataaagcatctctttgggagagttctttcttgtagtgtttaggtctcaatcctctcatgcacga

SEQ ID NO: 18842 - DNA, 401 bp, Homo sapiens
gccttgaacagaacaaatgccctcttaacccggttcctttggcggtatgtacgtcctgatacctaaacaacgtttcctttaatttattttttgggtgtgtgccaaggcctgtagaaaaagaatttgatggctttgatttctgggacttcctgatcatttttgaggaggaggagttcctaactaagctggagggcacatactttctccacatgagtggggcacccatgatgtcagcgaggacagtgtcagatagatgcacagcccatcacccagaaactaaggtcttgtaagaataccttagtgaattgtgccagatggaataaattctgaatcctttataaagcatctctttgggagagttctttcttgtagtgtttaggtctcaatcctctcatgcacga

SEQ ID NO: 18843 - DNA, 1826 bp, Homo sapiens
taataatcaataatttcttattttaaaaagtagtactatttaatataatcaagataggagatttaaaatgagcaagtgattcatttgctcttttaaagaagcccgttgacttacgcttttaaaaaagaagttggtgggttacctcaattattgttcatgcttaaacatatccatttgtacaggcttatttctacgtgggacccaatcatatatactatatttctcaaataatttttctaaaactctggcctatattctaaacacttgaccaacaccttagttattgaataggtaaccatttttaaagtacatgtggttcattttttaaaattcaatctctcaagaccgttagatatttaataatttaagctgataagggtatcaaaatgcacattaactttgatcatcatgatttaagttgtaactttgtgttattatataaatattaggttgtttataaatatattgcaggaaagtattcttgttaagctctttttaaatgaggggactgtggtttagagttatatatttttgcttatttttaaacttcaattattccattcttctgccttataataaaacttttaaggcagagaactgaactaattatagaatttctcctttggagagttataatgttacatagtgaacattcttataaaagaaagaataagtttaagttgatgaatatttagctgcaaagattttttacttaaaaaaatccatgaatatctttgattttattataaagcatttgtaaattatttgcatttgagctgtaagattcataaacatttacatttcccaatgatttctattttgatttttaaaaaatatacagggcaagctacatttttaaagcattaatcaacaactttattatattacacattccagtgcacaaacacacaatatcatttaatactcacagtagtacctgtgaaatatatcagatggatattcctatctctattttacagcagaggaaaccgaaattcagagaacttacatttctaaggttgtacagctgcaaaatgaccaaattgtgaagtccctaacatccaggttttcataatgccagtactctttctatgacatgtttatgaccctccaaatgtaccaaaactacctaactaattcactgagaggaagccaactgcaaaaataggatttttaaaagtacaatagagtattactacattttatggatttcagacaaagaaacctccgtttattatatcctgatggtgagtattgccagctctaaattattcatatttctaagaccaaggaaaatataggtaaatgaaaattttgaaataaagaacaatgccttaatttgtaaaatctatcattgctaccaccctgcccaggtctggccatttgccataaatgctggtaaataaatacaatgactgatagagttctgtctcctttctcttttgctacccaaccttggttagagcaaccaaatgtctaaaaggcatgtaacaggagaaaaaaataaaaacattagtcaccaattcgccgattataaaagggatgtagattcctttaaattattactgaccttttgaaagccttcacgtaagtatgcaacagataaaatgactcatttacccacaacaataatctattatcagtcttaagtaatgtgaattcactgtatttctttttatacaacataaaaacttctgctttccaaacttcttccttttcactaatttatcagccactttatttatacacagataacacttttagaaacatttttctttcttgtccattttcttctttcaaaaataaagtttcttagaacctgataa

SEQ ID NO: 18844 - DNA, 273 bp, Homo sapiens
  misc_feature (26)..(26): n is a, c, g, or t
cgcgactctgaggatccccctggctngctcagctctaaattattcatatttctaagaccaaggaaaatataggtaaatgaaaattttgaaataaagaacaatgccttaatttgtaaaatctatcattgctaccaccctgcccaggtctggccatttgccagacctgagcaagccaggcctggcttgctcaggtcttggtgacaaatatgttgtgtagagttcaggggagagtgcgtcatatgttgttcctaggaagattgtagcgatgggttt

SEQ ID NO: 18845 - DNA, 918 bp, Homo sapiens
atgaaaagcacctaaattcttgaaaattacaagaatattgagagatatttaaagggttgcaaaagcagtcccatgggactttgaaattactagttcttaaaaaaactagaggctggaacatgatcatctttgaccagatcatcagattgtccaactttgcatttagatgaattgttcccagcctaattataagctcttctcttgaccagcctccccaggagtgtggtgtcttgccatcaatgcatgcttctgtttggtaggaaccactggactggctctaaccctgaggtccacaccagggtgacttatctaggatttctccatgagttgagcatttatttctcaggatcgtgagaacctgagcagtgctactcaaagtgtgggccacaggcagggactgggctgtaatcccatgattatagcaagtgagagagagtaagtgttggaaacttgtagaaccatttgatattgccacacattcaagtgtgtgatcatatttctagtttattttcattgtatctggaaataacaggccataatggattaaatgtttaaaaagaaaaaacctgtcattagccacagatagtttgaggagcaatgagctagcagaagccagctagttagttatatcctcactctgagagccggtaaggccgtcctgctgtcaagaaatagaagataacccttgatgcccagggcaacattcaccttcacattggcctttggggttggcttcaaaggctctcccctcatcccaggagacaagttctccatcaccttatttccctgtggcctctcaaagaagtgctggtctacctcttggtgattctggaatgcatttcatcaggttgggaagggcaggtaggagacccagtactgatttccttaagggtgcttccatttcactttaaaaaaaaa

SEQ ID NO: 18846 - DNA, 358 bp, Homo sapiens
gatttaatgttaataagaactccattaaaatggaatatatttataccttagtgtataaataaatatccactatgtcattatctcctatatatactttaatttacttgcataaatgatcatttagagaaaaatatttgagataaaatgttacattaatgataaaataggtttagtttatgtaaagttttcttggaactaagatgatttacttttgggatatttacttggaagaattttaaaatgtcacacactctggagtatgtgaaaacttatcacaattttttcctcttaaggtttttcattgggcacgagaatctcctccagactttcacaaacctatggatacctactatgactc

SEQ ID NO: 18847 - DNA, 361 bp, Homo sapiens
aactatttcaggagtaagtcagtatctatagtaggattcttaagggcttccctcaccccatatcctaaggcttgtgtttaccttaaaatgtcctctcatctgtatgaggtttcagaggttttgagagaacagtgtcagagtcgtagtgttctagggtccagcacgttctatgtgaatgaatttaattttatctttattttttggtcaataaatagttttgcccttcatatggagaaatgggataatatttcaacatttaatattacataatactttttgtcttatgacggtactggggattatcccaaaagacacatgaggaaatatagtatagctaagaaagctgtggacttagccaaaa

SEQ ID NO: 18848 - DNA, 1059 bp, Homo sapiens
cacatgatgcaaatcagcgtgttcctgcctgctgcttggctgcagttaattttagccggggttagttctatgagttgtaaaagtagaagttagcaagctgaaatgtgacttctcggcctaatgtggtaggatatctattttagacttcagattgtgtttgtgatcaggagagcagtcttctgaagaattgtggctcagttttcttggaaactacttgtaagtactgggtggaattttaagacttctctttgttcttttctccttaaatcttcctaatgttaccgtcatagtaatgtttatctcttgggaaaactggaagctttcaggttggtacgttagagaaagctaagagaggtggcaaaaggtttttctttaaatgtctcctactgcaataaatctgccttattcaatttgcccaagaaaaagttttcgattcttacttatttttgcaaaagcaatctgtagattattattttatgttaaaatatttgattaatggatatggtttctgtaaatacagaaacattgtattgtgtcattgagctttgttttctactatggtaacctaattcttgagaaaaaaatgttgaaagttaattcctgttatactctgtgctacaagtttattttgtagaaataatggagtgtcaaatgtaattttcttgaatgtatagatggacagttttttatccttttaagggggattttgtgcttaaaaaataaacccatatatgcctaaagagaagcactttaaaaaattaatttaggaagaaggttttagagaataatttaaagcatcctcttttagactgagttagttatcaaaagtaaccaaaggccatgggattctgtaaccttaactgcagttcatctaacacattattaccaacttaaatttgtactgaagaaaacaaaagattttgatattgaatattttaaattaaatttgaatcatcttgcttatttagaagtgtgttttcaatgtggactgacctcaagccaaacagtttgcttacagcagagaaccaggcaggaatttctttatcaattagcaagtaa

SEQ ID NO: 18849 - DNA, 372 bp, Homo sapiens
gcatttattctggtatacttgtatcagaattgctctagatacatacctagtgaagatattcctatcttacatagaagcgatccttcaggactgtgtgtaggatgttctttctctttggtttttgtcacctctgaagatggatggaaaatgtgtaggcattggaacagggaccccatttttttctgaaggaaaaaacatgttgtttgaatgtgatctcacgtgattgagaaaataatttatgatgtccacacacctagttacaatgacttgtaccaggaggggagcccaaatattttttttttttgctcattttctccagtttgaatggggagtaattatgaaaaataaacagtacctgcttaaagtatataa

SEQ ID NO: 18850 - DNA, 504 bp, Homo sapiens
tttgcgtttggagtgtatgctgttggtggtaatactaagttgctatccatgagggtgcagaaaataccagtggcccagatactgtacttctataaaggctgccctttacttggctgcagctgctgtttgcaaaagtcactgctcttttaaagtatagcttacattattcagccaaataccagcaacagttgggcttttgctcccctgtcaatcattgggcaattatgtattcttcagttatgtacccatccctaggtccaatagtttttaattttaacttctagatcagagctttcatttattgacaaaatttctaatatccctttactaagaagtacaagactgtaaaataaatagactaaacttttgtgcaaaattatgaagtctacaggggaaaaaaagaaatcccagattcacgtgtgccagaaggtttataaaggtaccactcttttttagaaaagatggaaaggtattcggggggaaaaaaaaacacgattttatatg

SEQ ID NO: 18851 - DNA, 300 bp, Homo sapiens
attctttggctcagcaggacaatatggtgggaaatgacaaagtaactcctgtggccctaggtcaggttctcttgaggaaaacaaaaaggctggaatgatacagctcttcgtaaaccaggtgcctccagtgcctgcggttattcccaagtccacattttgcagacagggccctaaaatgtctagctaggaagttcctgagcctgtttttttaaaattctacacacacacatgcacacacacacgcacgtgtgcacacatgcggatatatacatcctcaccttttcttgagattactgctca

SEQ ID NO: 18852 - DNA, 2041 bp, Homo sapiens
  misc_feature (906)..(906): n is a, c, g, or t
atagcaaaagcttttaggctaagaagtcagttattgctgagttctctctccattcccccaggtgggtgaggtcaactgagcctgggcccccactgcccagctgacctgtgcagagctgccaagtgaccacacggcaatccttaccctttgtctgtccctgtctcccttgtctctgtacctctctgcttacccctagctgtttctgtgtccagccatctgtctctacctggatcccaatgatcctgaaacacatcagtaaagccttcttcatcactgccacgcacaacagacttgtgcctgggagttctatctgtgtgaatgcaactgcagaggaggaaagagtgaagcaaaaattgggagagtttaggggtaagggaagtctacctcacagaacagaggtacttcccttggggttggaaccactcgtgtttgcagtttcagtttctgggaaagaaagggaatgaacagatttatcacactggaatcttgaaaaggcaaatcgccaacacctgagacgcggtcaactctggtatgtgccagtgaggggagaacggaaggacccagggctcgcagcctcagccggtcattagggcaccttgctatggacccttccttcaagacccaccataaagcccatccagagcccttccaagaggccccgggagtagttttctccagagagggcagtggtacggggaccaagattcctctgacttatatcaaaccagaggcaactcccacacagaggctgtggaagggtaagcctgtgtgcctcaagaaaaatgcttcaaagcaaaagcaagtaagagattctagatgattcttacctgctatgaaagatgccttgatgtctgaagaggcttcggcctgatctccctgaagatgctgaaatgggggagaagcctnatcacctctgtgcaagcaaaggagtgaagattatttcttgaacacctggacaacatatctgttcaactagcttgcaccctggtggagctgggggcagcatttctggaatcctcctaaccattgttcactgcttgtagcagagtaggtgggcctcagggttagtgacaagtcctttcctgcccttcccaacacccagccaccttgctgcagtctctgtagcctgggctctgaaatacatgagctcctcgggagctgcctatccatcctacagcttagtggttagctgtttaattgtaggccaagaatttctctccccaccacagccatctaaatgagttttactagccaggaacctaaaaacacccttcgtgggcttccctatgaccccagctcgattgaccctgtaggttcaaaaggtttcgaggtggcacctaaccagaatgtgggcagaaggcagaggagagggagccttctttctgtctttatctctttatgcttatcctcattgaccatgggctgagttctttctctgggtcccctaatgtgggaatggagtggttcttgccctctgagcttacagactaagaaggcagaaaagctttacaactacagagtacatgtgtatacacacaaccaacctaaacacatcagagaatacatacttaaatcaattcacttcatatacacatctcattagaagaccaagctaaacttcacttagagggcgggcaaaggactagaaaagaatttttctcttaaaaaaaatgagtactagagcaaaattatgagtgtctaagtatcttagttatgcttcataagatctgactggggtaagagataaagaggtaaatagggctgggcgcggtggctcacatctgtaatcccagcactttgggaagccgaggtgaacagatcacctgaagtcaggagttgaagaccaacttggccaacatggtgaaaccccatctctactaaaaatacaaaaattagccaggcatggtggtggacccctgtaatcccagctacttggaaggctgagggggaggattgcttaaacccaggaggcagaggttgcagtgagccgtgattgcaccactgcactccagcccaggtgacacagcaagactccgtctca

SEQ ID NO: 18853 - DNA, 1508 bp, Homo sapiens
acacagctgtgtgggccaagggggctggtgtatctccacatgcaagcacgtagataccgaggaacctggccagccctgcagcctgactcgggatggctgcctctatgccctctgcgtctgactttctcctttgagataaaggtgttttggcccaagctgagtgcattgctgggcagcggccatgccgaaggtggtagctgaagggacccttgatcgaaagacgctctgccatgctttctgagtcctgtctcctccaagcttgtctcctagactgtttcccctgtctgttttcctgcgcccttgtgtttggccatttttgcattaggctgtgtctctgtacccaaggccacgtgacaaggtagttggaacccccactcaagtggtgagtgaagagcgtcgtggtaataataatagtagtaacacaacttccaaatttctcagtggagagtgtcacgtccggggggtatcaagatctgtgaggcctttccaagccctcaccattccctctttggtcccacgttgggtgggcagctgggaaggtcctagttgattttaatctccggtgctttccccagaactgctgctctgaataaaccaaagctgtgaaagagtgttctgcgcaggctgcgggcccagcctctgggtgcaggccctgggcacttgagctgagcagctcagctggctctgctgtgagggaaagccgtgaacttaactgtgctgagagctgggtgagggcaaaatggggaagactgaagaagaaggagcaggtggggagagaccagccgctaacatggtgtctacttctccgtggatcagagaagggatgagtagcaaatgcagaggcagggtggtctcccagcaacaaggatgtccagagttctcctgaccctgtctgcacccacttccatgcaaggcagaggcatcacagttttccatcccaggccacccttcactcttccaagtgtcaggcctctttaaatctgcatcccttggggttagaagcaagagaggtggcaaagtctccctggcactgagagcctgtcccaccatgccactcggcatgagatggtggaggaagaagccaagagcagggatgccttccctgtccccgtggcctctcaggactcccacaagatgctgtggacccaagatgagagatttcaggatggggccactggccttcctaggttgggctctgggtcctttcaataaactgttcctttcctgattcttactcccttctggtccttccactcccttccctctgcccaggtatggaaaaggtggctgggctcggtgtgcgctccaaccccggtagcattagctgagtcacgcggcgagcacacaacagatttgtagcagctcatctgccatataaaccgcttggctgatggagtcctcattgagttttttcattatcgtgtaaagtggaatcatgtcattcacctttactataaacaaggctgtgagaacataataaacagaacctgaacaagctgctctctgct

SEQ ID NO: 18854 - DNA, 1768 bp, Homo sapiens
gaattttgcagctaagcaagggtatgtgggcatgtgtccatgtgtagaggaacgtgatagctaaatttatggtactcctgtggagtgtctctgtgtgtttgtgtgtgtgtgacaactgtgagcattagactagtacacggcagacatgatcttcccgtggggtggagctttcctcataccttgtatgccctgcttcccacaagaggcacagagctctccactctgatgcctactttcaggcactctggtcgtgccaacccagattttggtctgtgatgaaacaaagagaaatgtttacaacatctagagcaatatccaagcatacctcatccctgagcttccatgtttcccagtcctgccctctatgccctctgcgtctgactttctcctttgagataaaggtgttttggcccaagctgagtgcattgctgggcagcggccatgccgaaggtggtagctgaagggacccttgatcgaaagacgctctgccatgctttctgagtcctgtctcctccaagcttgtctcctagactgtttcccctgtctgttttcctgcgcccttgtgtttggccatttttgcattaggctgtgtctctgtacccaaggccacgtgacaaggtagttggaacccccactcaagtggtgagtgaagagcgtcgtggtaataataatagtagtaacacaacttccaaatttctcagtggagagtgtcacgtccggggggtatcaagatctgtgaggcctttccaagccctcaccattccctctttggtcccacgttgggtgggcagctgggaaggtcctagttgattttaatctccggtgctttccccagaactgctgctctgaataaaccaaagctgtgaaagagtgttctgcgcaggctgcgggcccagcctctgggtgcaggccctgggcacttgagctgagcagctcagctggctctgctgtgagggaaagccgtgaacttaactgtgctgagagctgggtgagggcaaaatggggaagactgaagaagaaggagcaggtggggagagaccagccgctaacatggtgtctacttctccgtggatcagagaagggatgagtagcaaatgcagaggcagggtggtctcccagcaacaaggatgtccagagttctcctgaccctgtctgcacccacttccatgcaaggcagaggcatcacagttttccatcccaggccacccttcactcttccaagtgtcaggcctctttaaatctgcatcccttggggttagaagcaagagaggtggcaaagtctccctggcactgagagcctgtcccaccatgccactcggcatgagatggtggaggaagaagccaagagcagggatgccttccctgtccccgtggcctctcaggactcccacaagatgctgtggacccaagatgagagatttcaggatggggccactggccttcctaggttgggctctgggtcctttcaataaactgttcctttcctgattcttactcccttctggtccttccactcccttccctctgcccaggtatggaaaaggtggctgggctcggtgtgcgctccaaccccggtagcattagctgagtcacgcggcgagcacacaacagatttgtagcagctcatctgccatataaaccgcttggctgatggagtcctcattgagttttttcattatcgtgtaaagtggaatcatgtcattcacctttactataaacaaggctgtgagaacataataaacagaacctgaacaagctgctctctgct

SEQ ID NO: 18855 - DNA, 2428 bp, Homo sapiens
ttcaattagaaatattctggatttatacatctttgaagtttaatctgaaggtttcttcaggaagtaaatatctattcatcaccttttcccaagctccataaagttttttagtttatcccagtcgctaggagacagaagacggaagcggaaatgcctttcacgacaacttccggaagaggtcgccatggcttcccgggaggaggtactcgccttacaagctgaagttgcccaacgtgaggaggaattgaattcgctgaagcagaagctggcgtcggctcttttggctgagcaggaaccgcagccagaacggctggttccggtgtcgccgctgccgccgaaggccgctctgtcccgagatgagattctgcgctatagccggcagctagtgctgcccgagctgggcgtgcacggacagctgcgcctggggaccgcgtgcgtgctaatcgtgggctgcggtgggctcggctgtccactagcgcagtacttggcagcggccggcgtgggccgccttggccttgtggactatgacgtggtagagatgagcaacctggcccgccaagtgctgcatggcgaggcactggctggccaggccaaggccttttcggccgccgcctcgctgcgccgcctcaattcggcagtggaatgcgtgccgtacactcaggcccttacgccagccactgccctagacctggtccgccgatatgatgtggtggctgactgctcggacaacgtgcccactcgctacctggttaatgacgcatgtgtgctggcgggtcggcccctcgtgtctgccagtgccttgcgcttcgagggccaaatcacagtctaccattatgacggtggcccttgctatcgctgcatattcccccaaccacccccagcggagacagtgaccaactgcgcggacggcggggtgctcggtgtcgttaccggggtcctgggctgcctgcaggccttggaagtgctgaaaatcgctgcgggtctgggcccctcttacagtggcagcttgttgctctttgatgccctgagagggcatttccgctctattcggctgcggagccgcaggctcgactgtgcagcttgcggggaacggcccactgtgactgatctgctggactatgaagccttctgtggctcctcagccactgataaatgccgctccctgcaactactgagcccagaggagcgtgtttctgtcaccgactataagcgactgctggattctggggcattccacctgttgctggacgtcaggcctcaggtggaggtggacatttgtcgtttgcctcatgccctacacatccctctgaaacatttggaacgcagggatgcggagagcctgaaactcttaaaagaagcaatctgggaagagaagcagggcacacaagaaggggctgctgtccccatttatgtgatttgcaaactgggaaatgactcacagaaagccgtgaagatcctccagtccttatcagcagctcaagagttagaccctttaacagttcgggatgttgtggggggcctcatggcctgggctgccaaaatcgatggaacatttccacagtactgaggtgactggtatagtctgatgagaaagatgtggattgccataatacctcaaagatacacttgtttgcatttttcggtaatatacataggagctggggattctacagtatctgtgaatacgtggactcctttttataaggagttttaaaaattgttatgtattggatgaatgacttattaatggattataccgtttctgagaaccatcattttttttttcagcacacggaggatgtcttggacatgtgagatgtaacgtgacaggattttgcattttaaactgcagatcatttacatgtccttattttccacctcccccagtcaaaatgctttctaaatcattttcacagattatatacttcggatctgtttactgttcagttaagaaattcttggatcttattaatatttcagatgatagaatacatcctacagaaatacatgtttaaaatgtaaattgttttaattattcagaaagagggtcattctatttggccttttgaattagtatcaaaatgagatttttttttttttgagatggaatctctctctgttgcccaggctggagtgtagtggtgcgatctcagctcactgcaacctccgcctcccaggttcaagcgattctcctgcctcagcctcctgagtagctgggattacaggcgcacgccaccacgcctggctaatttttgtatttttagtacagagggggtttcaccatgtttgtcaggctggtctcgaactcctgacctcgtgatccgcctgcctcgacttcccagagtgctgggattacaggcgtgagccaccacaccctcccgagatctttaaagtttaccaaaataaaggaaaccacctttgtagtctg

SEQ ID NO: 18856 - DNA, 3208 bp, Homo sapiens
ttcaattagaaatattctggatttatacatctttgaagtttaatctgaaggtttcttcaggaagtaaatatctattcatcaccttttcccaagctccataaagttttttagtttatcccagtcgctaggagacagaagacggaagcggaaatgcctttcacgacaacttccggaagaggtcgccatggcttcccgggaggaggtactcgccttacaagctgaagttgcccaacgtgaggaggaattgaattcgctgaagcagaagctggcgtcggctcttttggctgagcaggaaccgcagccagaacggctggttccggtgtcgccgctgccgccgaaggccgctctgtcccgagatgagattctgcgctatagccggcagctagtgctgcccgagctgggcgtgcacggacagctgcgcctggggaccgcgtgcgtgctaatcgtgggctgcggtgggctcggctgtccactagcgcagtacttggcagcggccggcgtgggccgccttggccttgtggactatgacgtggtagagatgagcaacctggcccgccaagtgctgcatggcgaggcactggctggccaggccaaggccttttcggccgccgcctcgctgcgccgcctcaattcggcagtggaatgcgtgccgtacactcaggcccttacgccagccactgccctagacctggtccgccgatatgatgtggtggctgactgctcggacaacgtgcccactcgctacctggttaatgacgcatgtgtgctggcgggtcggcccctcgtgtctgccagtgccttgcgcttcgagggccaaatcacagtctaccattatgacggtggcccttgctatcgctgcatattcccccaaccacccccagcggagacagtgaccaactgcgcggacggcggggtgctcggtgtcgttaccggggtcctgggctgcctgcaggccttggaagtgctgaaaatcgctgcgggtctgggcccctcttacagtggcagcttgttgctctttgatgccctgagagggcatttccgctctattcggctgcggagccgcaggctcgactgtgcagcttgcggggaacggcccactgtgactgatctgctggactatgaagccttctgtggctcctcagccactgataaatgccgctccctgcaactactgagcccagaggagcgtgtttctgtcaccgactataagcgactgctggattctggggcattccacctgttgctggacgtcaggcctcaggtggaggtggacatttgtcgtttgcctcatgccctacacatccctctgaaacatttggaacgcagggatgcggagagcctgaaactcttaaaagaagcaatctgggaagagaagcagggcacacaagaaggggctgctgtccccatttatgtgatttgcaaactgggaaatgactcacagaaagccgtgaagatcctccagtccttatcagcagctcaagagttagaccctttaacagttcgggatgttgtggggggcctcatggcctgggctgccaaaatcgatggaacatttccacagtactgaggtgactggtatagtctgatgagaaagatgtggattgccataatacctcaaagatacacttgtttgcatttttcggtaatatacataggagctggggattctacagtatctgtgaatacgtggactcctttttataaggagttttaaaaattgttatgtattggatgaatgacttattaatggattataccgtttctgagaaccatcattttttttttcagcacacggaggatgtcttggacatgtgagatgtaacgtgacaggattttgcattttaaactgcagatcatttacatgtccttattttccacctcccccagtcaaaatgctttctaaatcattttcacagattatatacttcggatctgtttactgttcagttaagaaattcttggatcttattaatatttcagatgatagaatacatcctacagaaatacatgtttaaaatgtaaattgttttaattattcagaaagagggtcattctatttggccttttgaattagtatcaaaatgagatttttttttttttgagatggaatctctctctgttgcccaggctggagtgtagtggtgcgatctcagctcactgcaacctccgcctcccaggttcaagcgattctcctgcctcagcctcctgagtagctgggattacaggcgcacgccaccacgcctggctaatttttgtatttttagtacagagggggtttcaccatgtttgtcaggctggtctcgaactcctgacctcgtgatccgcctgcctcgacttcccagagtgctgggattacaggcgtgagccaccacaccctcccgagatctttaaagtttaccaaaataaaggaaaccacctttgtagtctgtcagtgtctcttataaattgctactgttttcttaaagttaacttcagggtccaccttatgttgcacacatatcacatcgtttaaattgcatactatggtttgacttgctttggaattttcaagtcaaagtcccaaccctttgcctctccccctttaatttgccttttctcttttgatttaatgtttttttattccagcattttatactaatgtaaaatgtttttatgtttgtttacttaacattttcataaaatagtaggtagtctcaccaacttccaatatatacaacaacattataagtaaaatttgatttgtgagtgcctatcagtggccagatgaactaatggcttgtcagaagggggcctgtgacctcctgcttgctgcatgcaggcttataatcatcaattgctgctgttgtttttttaagaatggcagaaatcacagatacaactataaaatctttgtatttctgttaaccattttttttaaagcttaaatgtatcataagccagcaaaaaccctttgtagaccagatttacttaccagtttgcaatttgtgatatagaatcttgttttattataagagggtggtatttaacaaattcaaaattagtcatcactttttaactgtgaaacattgtaactaattctttgaacaggtatacttaaagtatggtatacccttctgttataaagatgaagcaggtctcttatgactgttcctgccaacgagttatggaggtaaatgactgtgacctggagtggagaacaaaaagatgg

SEQ ID NO: 18857 - DNA, 222 bp, Homo sapiens
taatataattgtatagacatttttagcaatatcttttggcagcactcttcagttgttacattttatatgactcatgcaaattaacccttctgggccagtcgaggtggctcacgcctgtaatcccagcactttgggaagctgaggtgggaggatcacctgaggtcaggagtttgagaccagtctgcccaacatggtgaaatcctgtctctactaaaaataaaa

SEQ ID NO: 18858 - DNA, 235 bp, Homo sapiens
tgtaggcagtgtctgagccatttcccaagggcctccagtctcactaggaaagtcagggaaagggagagctggagacgaggaagctgtagcactggagctgggcataacaaacaggagccaatatggcagaaagtgggtaccggcaggcaggaatggagggagcggagccagctggcaaggtgcagatgagcagaccaaggaagagtggctgaaagctcatggtaccccacactgg

SEQ ID NO: 18859 - DNA, 657 bp, Homo sapiens
gaactctcatacactgctgttgggaatgcgaaatggtacaaccattctgaaaaacagttgttagttgcttataaaggtaaacatacacttactatattacccagcaatcctactcttagggatcagctttgagaaatatgaaggtagggtcacacaaaaacctgtacatgaatgtttgcagaagtactattcataatcaccagaaactggacatattccaaatgttcttcaacagacgaacaggttgacaaactgttatatacaatgtatatgcattggaacagttacatacaatactactcagcaataaaaaagaacaattgaaaaatacaacaacatggttaaatctccaaagtattatgctcagcaaaagaagtcagtctcaaagggttatatagtgtagtatgattctacttttatgacattctggaaaaggtaacaccacaggaatggagaaccaatcaggtttccaggggctggggattagggaaagtttgactgcaaaggaacagcaggagggagtattttggggtaatggaactgttctgtatcctgattgtggcacggttacatgaacctatacatgtgtaaaaattcagagctgtacaccaagatttgtttcaattttactgtttgtaaaattttaaaaataagaaa

SEQ ID NO: 18860 - DNA, 777 bp, Homo sapiens
tggaaacaccaaggtgctgggcacctctccagctttacagactgcacatgctttggtcatgttcatatttaaataagaatcaactggtatttctgaattagaagaaatctaagggaacatttttgctcactccctcattttagagatgttgctaaaggagaaatgaagtgacttgctcaaggtcaaatagctgaagtcaccaggccagggttaagagccagacccgtgggctcctacaccagtgctctttttctctgtcctctctagtagggtccatgaagaatctgcatgcccggctctctcctctccaccgctggcaactcgtaaaatctgggtgtcacacagctcgctcccaagcattgtcagaaataagaagacaccatcagaaaggggaaagctggatgggcaagaagacaggaaaggaaaaagtgaccaaatgaagctgagcttctggcctgctacagttcatcatttctactgacagcttgaaaattaggaaagacacagaagttgaccaggaaacaataagaattatcagaatctccattagctattttttcaaaaaacgaaattgcacaagccaggctgggcaacatggtgaaaccccatctctacgaaaaatataaaaaattagctggcatggtggtatacacctgtagtcccagctacttggggggctgaggctggaggcttgcttgagcctggaagattgaggctgcagtgggctgagatcacaccagggcactcaagcctgaatgacaaagtgagaccctgtct

SEQ ID NO: 18861 - DNA, 893 bp, Homo sapiens
ttgactaggggctaagagacttgaggggaactagcccacttctgatgctgcatgactgagaagaagtagtatcatagaatcatggtactttaaagctggagagaaacatctcaaaaataagcaacctggaccagagattaaactccaggtctgagagccagataacagccctcctcaagataaccagtcaagtttggcactgcaggccctgagccattttggtccaccctgctttgaccccaccccttgtccacatcagctcctgtgaagccaccccagaagaaaaccactattcgttcacattggctgattgatgctccatacgtccaaaccttccagtcctcaagaaacaagtatggctgagttctgggtaaaagtggagaacatgaccctctcctcactctgtgccatgttttatataagaaataaattaaaagtatataaaaacacatgtgcatatgtttacatatatgtatatatacatatattaatgttatataaatacaatatatatctcatttttacgaaaagaaactaacaaaaataagggtaagtttggaagagatagaaatgagaatatttctgactatatttttatacggtttttacttttggaacatgtaaatgttttacatattcaaaaaaataaaattaaaaaggaaaaatgcactcccttaaacaaaatacaagtagaaacaaatgatccaaattatatttcagtttggtaaaatatccacccagaggaaatagttactttgaataacatataaatggcaatcagaggtttattttgctagtagaaatactggaattgtaattttaaaactgttttaaatacattttaggtaaagaaaataagtgtgtattaatgttattagaaaccgagattttca

SEQ ID NO: 18862 - DNA, 794 bp, Homo sapiens
atcaatcagggatacccatgctggacttcgaataaagattaaactccaggtctgagagccagataacagccctcctcaagataaccagtcaagtttggcactgcaggccctgagccattttggtccaccctgctttgaccccaccccttgtccacatcagctcctgtgaagccaccccagaagaaaaccactattcgttcacattggctgattgatgctccatacgtccaaaccttccagtcctcaagaaacaagtatggctgagttctgggtaaaagtggagaacatgaccctctcctcactctgtgccatgttttatataagaaataaattaaaagtatataaaaacacatgtgcatatgtttacatatatgtatatatacatatattaatgttatataaatacaatatatatctcatttttacgaaaagaaactaacaaaaataagggtaagtttggaagagatagaaatgagaatatttctgactatatttttatacggtttttacttttggaacatgtaaatgttttacatattcaaaaaaataaaattaaaaaggaaaaatgcactcccttaaacaaaatacaagtagaaacaaatgatccaaattatatttcagtttggtaaaatatccacccagaggaaatagttactttgaataacatataaatggcaatcagaggtttattttgctagtagaaatactggaattgtaattttaaaactgttttaaatacattttaggtaaagaaaataagtgtgtattaatgttattagaaaccgagattttca

SEQ ID NO: 18863 - DNA, 408 bp, Homo sapiens
agttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaacactatagacattgacatggaaaagagatttaatgttaataaaaactttatattaactgagtaacacctcctgatgagaagtgctatattaaatataaacccattatgttgttt

SEQ ID NO: 18864 - DNA, 2654 bp, Homo sapiens
gagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacgggagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcagggctgaaggcctacagcacctgggagaacatccgctgcctgcaggactgccgcgagtgcactggaggcatgggttacatgatggaaaatcgaatctccggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagagatgctgaaacacaaacaggtataagactcagtctccacatgaagggagctcatatccaaggacacaaaaccactttaaaaacataaatactggccaggtgcagtggctcatgcctgtaatcccagcactatgggaggctgaggtgggcagatctcctgagctcaggagttcgacaccatcttgggcaacatggtgaaaccctgtctactaaaatacaaaaaaattagctgggcgtggtggcatgtggctgtagtcccagctactcgggaggctgaggcacgagaatcgcttgagccctggagttggaggttgcagtgagcagagattgcgccactgtactccagtttggactacagagtgagactccatctcaaaacaaaacaaaacaacaacagcaaaaaacaacaaaacaaaacacaaatactctcacggggcatggaggttttcgaacgaacttggccataagaataaattcagagttgacagaacagacgtcttaggaataaatgccattcttatgctagaccttgaagagtagaaaattaagagatggtggcccaattgagaggggaaaatgcagttgaaacttcagacagggttgataaagtgaggacgatcatagacatggagtacttagacatattaataaacaataaagactttacctgtctaatggaaaacctggagaagtcgtcaggaaccagactacagtggaccctggagaaccttgaagaacatttttccttttcaggaaaacggaggttacagagaaaagtatatgtaatgatgctacagtaatgtatttctgtataacaaatgactccaaacttacgacttaaaacaaccaccactt

SEQ ID NO: 18865 - DNA, 1480 bp, Homo sapiens
  misc_feature (1350)..(1350): n is a, c, g, or t
  misc_feature (1366)..(1366): n is a, c, g, or t
  misc_feature (1372)..(1372): n is a, c, g, or t
  misc_feature (1455)..(1455): n is a, c, g, or t
gagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacgggagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcagggctgaaggcctacagcacctgggagaacatccgctgcctgcaggactgccgcgagtgcactggaggcatgggttacatgatggaaaatcgaatctccggcttaaagtgtgacacagatgtgtttgccacttttgaaggtgacgatgttgttatgcttcagggttgtggggggcggggaaactggctgggcccaaatncacccaaaaccagttntgaaangaaaaaaccactcctttgggcctggctccaaaaaactggggcctgaatctgttgggggggaacaaagcctggagaaaccaagnttttccctgggcaatttaaccattg

SEQ ID NO: 18866 - DNA, 1891 bp, Homo sapiens
gagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacgggagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcagggctgaaggcctacagcacctgggagaacatccgctgcctgcaggactgccgcgagtgcactggaggcatgggttacatgatggaaaatcgaatctccggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagatgtggcttggaggaagaatgcgcagaagtgtggtagacaccaggcccccaagccaggatgctgcttggctcctttgaacgtagaagatggattacactcgtttactattttaatctaagcataaagtataaatgcagtcactgcttagtgtcacaaaggcttgtgattaaagaacacac

SEQ ID NO: 18867 - DNA, 1802 bp, Homo sapiens
gagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacgggagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcagggctgaaggcctacagcacctgggagaacatccgctgcctgcaggactgccgcgagtgcactggaggcatgggttacatgatggaaaatcgaatctccggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttttgtctgttgtatggaaccaagctggtgtttcaggagcgggcctggtatttagaacataaatacttgactcccatggccagcacgaggatcaggaatcagttgctggatttgtgcgactcggtgaaggatgatgcccggagggtgatctcgacctttaacattccacacacctacct

SEQ ID NO: 18868 - DNA, 851 bp, Homo sapiens
gagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccagatggggaaacagaggctcacggaggttaagcagctgactctggctatgcagttaatgacataaatgacttagctacctggcgtgcctcggcagctaccactgtctgataggggacctgcaaagttgcaatcataatgacgaggggcctctggtgaacactgtctcccgtggggctgggagagagaacaatcccatcataaactcataccaccgagaactgacatagcaggaatgtatttctcccttcactgggttctgtgttttccccttcatttccctttcaaaatgctagagcttattaaataagtgttctctccccaaggaccatttaaatctcttaca

SEQ ID NO: 18869 - DNA, 502 bp, Homo sapiens
cattttacattaggaaagtattaacttttacgattttatgaaatgtaatattatgttatttctctttcgcctccttagattttgtgttttctaatatattgctatttgtccatttcttttgttttcccccaccccttagttttgtctgttgtatggaaccaagctggtgtttcaggagcgggcctggtatttagaacataaatacttgactcccatggccagcacgaggatcaggaatcaggtaaggtccctggggtacagaaaaacactttgtacatcagccctggtctccttgctttcttagaaaacagtcctgccaatcttctatcagtttccactcatggatttttatgcctctgggacttcacatgtatattttcattacctatcatgatcgtattacacttaagagtttaggtgacaagggagtgactcactgtacatgagttttctaacatgaaaaggagaggaaggtatcaaaatgttttccttgtcttggcca

SEQ ID NO: 18870 - DNA, 3370 bp, Homo sapiens
gggtagaagattatgtaaacacattttgaaatttttaaaaattcagggtttcatcctttattagtttgctaaggataccataacaaagtaccacaaactgagtgacttacacaatagaaacttattttcctgcagttctggaggctgaaagtccaggacaaggtgtcgacagctttagattcttctgaggcctctctgcttggcttgcagatggctgcccttccttactgtgtccttgtatggtccctctgtctgggtgtctgtgtcctaatcttctcttttaataaggataccactcaggttggattagggcccatcctaacaatcccattttaacttagttacctcttcagggcctatcttcaaatatactcacattttgaggtacaggtagatggttagggcttcagcatgaatttttgtggggacataattcaaccctccacacataattaccaatttctgaatgtctttctggttaagttgcataaaaacgtttatctacttgaactctaggatgatagttaaaaaaaaaaatgttggccaggcgcagtgatggatgcatatgatcccagcactttgggaggccgaggtgggcagattgcttgagttcaggagttcaagaccagcctggcaacatggtgaaatcctgtgtctacaaaaaatgcaaaaattagctggacatgatggcatgtgcctttggttccagctacttaggaggctgaggtaggaggatggcttgagcccaggaggcggaggttgcagtgagccaaaatcgtgccaccgcactctagcctgggcaacagagccagaccatatctcaaaaaaaaaaaaaaaaaagtttatctacaaaaatgcttttgtgcctcttacatacaacccttccagaggaagggcctagctgagagtaagagatggttgaaaaaatgcaatgttatgattgctgaacagggcacgactgtttttgtaatattggagaaaataattaaagcctggcacctggggaggcttgatccctggaagcctcctcttgctgaaggaaaattcccagtgctgcctttccatgtgctgtgagtgctttgagttcagactgacaacagagtgggtctagcttctatgctttccatgaagatctcccacaaatgtcatccatgctcatgagatggatcaacttgtatcctgaacaagcaaaactgtttgggactcactgccttcaggcagtcccttggaagccaaggactctgggaacttttcagatgggactggaaacacttgggcaggagttcccctggtaggaggtctgttcacctgtacagcctaatggatgtcctgcttgaggtgccctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccacctggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtggctcactgtgcctaaactgttcgtacaaacaatgtgggttatgcccaacatctgctttccttctgggagtcagattttcatatgtgttaggcagaggatgaggtgagcagctcccaatgagaaccctgaacactgagtctgtaatgagcttcccttgtatacaacattgcacatgggttgtcacaactgattgctggaggaattgtgtcctatgtgactctgctgggagaggactgtgggaggcttacacctggtttccctggactttgtccatgcgcttttttcctttgctgattttgcttcctagcctttcgctgtagtaaaacatagccatgagtatgactacaggctgagtctgtgaatctcctagtacatcatcagactaggaggtggtggtgttggcaccccccagcacagggcacaagggagacttgcagggtgtttgtcatgttccctttctcaatctgggtgtggtttacagatttgttcagtttgtgaaaattcactgagctctatgaacaattataatatgtacatttttttctgtaagtgtattaaatttcaataaaaagaattcacactataggggtacaaaataacttaatttttcaaagtcttccttttattcagccaacattttagtaagtacccttttttttttaccaagcactgctctgggagcttgggacatggggtagaaaggacggcatcattgtcctcattgtccttcagcttagctgcaaggcaggtgaaggatgcttatagtatggttgatttttgctgggctctatgaaggatcagagggtgctaaggaggcacagagaaagagcttttaacgtgggtattttactgttccagggttgccactcaagtacctacagaacaaacgggtgtagctgtaaactgtggcaaactgaaagcatgtaggcacagagtaagtagctagagctgatttttttcaggaaaggccacaaatcccaacttttatgagctcctcttttaaatgctgtaaatgttttacaatggcggggcgcggtggctcacgcctgtaatcccagcatttgggaggccgaggggcagatcacttgaggtcaggagttcaagaccagcctggccaacatggtgaaacctcttctctactaaaattacaaaaattagccgggcatggtggtgc

SEQ ID NO: 18871 - DNA, 2773 bp, Homo sapiens
gggtagaagattatgtaaacacattttgaaatttttaaaaattcagggtttcatcctttattagtttgctaaggataccataacaaagtaccacaaactgagtgacttacacaatagaaacttattttcctgcagttctggaggctgaaagtccaggacaaggtgtcgacagctttagattcttctgaggcctctctgcttggcttgcagatggctgcccttccttactgtgtccttgtatggtccctctgtctgggtgtctgtgtcctaatcttctcttttaataaggataccactcaggttggattagggcccatcctaacaatcccattttaacttagttacctcttcagggcctatcttcaaatatactcacattttgaggtacaggtagatggttagggcttcagcatgaatttttgtggggacataattcaaccctccacacataattaccaatttctgaatgtctttctggttaagttgcataaaaacgtttatctacttgaactctaggatgatagttaaaaaaaaaaatgttggccaggcgcagtgatggatgcatatgatcccagcactttgggaggccgaggtgggcagattgcttgagttcaggagttcaagaccagcctggcaacatggtgaaatcctgtgtctacaaaaaatgcaaaaattagctggacatgatggcatgtgcctttggttccagctacttaggaggctgaggtaggaggatggcttgagcccaggaggcggaggttgcagtgagccaaaatcgtgccaccgcactctagcctgggcaacagagccagaccatatctcaaaaaaaaaaaaaaaaaagtttatctacaaaaatgcttttgtgcctcttacatacaacccttccagaggaagggcctagctgagagtaagagatggttgaaaaaatgcaatgttatgattgctgaacagggcacgactgtttttgtaatattggagaaaataattaaagcctggcacctggggaggcttgatccctggaagcctcctcttgctgaaggaaaattcccagtgctgcctttccatgtgctgtgagtgctttgagttcagactgacaacagagtgggtctagcttctatgctttccatgaagatctcccacaaatgtcatccatgctcatgagatggatcaacttgtatcctgaacaagcaaaactgtttgggactcactgccttcaggcagtcccttggaagccaaggactctgggaacttttcagatgggactggaaacacttgggcaggagttcccctggtaggaggtctgttcacctgtacagcctaatggatgtcctgcttgaggtgccctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccacctggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtggctcactgtgcctaaactgttcgtacaaacaatgtgggttatgcccaacatctgctttccttctgggagtcagattttcatatgtgttaggcagaggatgaggtgagcagctcccaatgagaaccctgaacactgagtctgtaatgagcttcccttgtatacaacattgcacatgggttgtcacaactgattgctggaggaattgtgtcctatgtgactctgctgggagaggactgtgggaggcttacacctggtttccctggactttgtccatgcgcttttttcctttgctgattttgcttcctagcctttcgctgtagtaaaacatagccatgagtatgactacaggctgagtctgtgaatctcctagtacatcatcagactaggaggtggtggtgttggcaccccccagcacagggcacaagggagacttgcagggtgtttgtcatgttccctttctcaatctgggtgtggtttacagatttgttcagtttgtgaaaattcactgagctctatgaacaattataatatgtacatttttttctgtaagtgtattaaatttcaataaaaagaattc

SEQ ID NO: 18872 - DNA, 3142 bp, Homo sapiens
agccctgaaagcatttgggttagcttccgcttactggtcagagttatactgtgcctgaattgatgcctcaggtcaggttgaaaaaaaaaaaggttcagacagcaattaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattggaaccagaacaggctgtaactgattatttttgctgtgattcgtgcttactggagcctcgggaaagagggagacaacatgtaaagagaagcaatctgtttggaaaatgaaaatacagttaaattgctaatgaacccttgtcaaaatcaaatgtctccccttagaggctgatgattgtctagtctaatatgcattttttttgagtgggtcaattggactctaagaccaacaagataaaaaggcagccttgcatgtcacttggaccacagctgtctggccatgcagcatgccttcactgctgctgaagaaaagcagctgcttgttgagaatctcaaattctcagatcctaattgcctggccctgactctaagctgaaacctgctactgtctgccttgagctgttttagcctcaacacgagctatgctgaactgaaagcaggcacaggctcaatgaccaggactcagacgttggggccgttggagattaaggaccccctccgtggagcgctaaactatgaaaacgtcctggaacctggctgaaaagggcttattctctaatgggaccatctaagatcaagctgctgataggctctttgtctctaatacagaggctaattgcattcctaacttctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccacctggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtggctcactgtgcctaaactgttcgtacaaacaatgtgggttatgcccaacatctgctttccttctgggagtcagattttcatatgtgttaggcagaggatgaggtgagcagctcccaatgagaaccctgaacactgagtctgtaatgagcttcccttgtatacaacattgcacatgggttgtcacaactgattgctggaggaattgtgtcctatgtgactctgctgggagaggactgtgggaggcttacacctggtttccctggactttgtccatgcgcttttttcctttgctgattttgcttcctagcctttcgctgtagtaaaacatagccatgagtatgactacaggctgagtctgtgaatctcctagtacatcatcagactaggaggtggtggtgttggcaccccccagcacagggcacaagggagacttgcagggtgtttgtcatgttccctttctcaatctgggtgtggtttacagatttgttcagtttgtgaaaattcactgagctctatgaacaattataatatgtacatttttttctgtaagtgtattaaatttcaataaaaagaattcacactataggggtacaaaataacttaatttttcaaagtcttccttttattcagccaacattttagtaagtacccttttttttttaccaagcactgctctgggagcttgggacatggggtagaaaggacggcatcattgtcctcattgtccttcagcttagctgcaaggcaggtgaaggatgcttatagtatggttgatttttgctgggctctatgaaggatcagagggtgctaaggaggcacagagaaagagcttttaacgtgggtattttactgttccagggttgccactcaagtacctacagaacaaacgggtgtagctgtaaactgtggcaaactgaaagcatgtaggcacagagtaagtagctagagctgatttttttcaggaaaggccacaaatcccaacttttatgagctcctcttttaaatgctgtaaatgttttacaatggcggggcgcggtggctcacgcctgtaatcccagcatttgggaggccgaggggcagatcacttgaggtcaggagttcaagaccagcctggccaacatggtgaaacctcttctctactaaaattacaaaaattagccgggcatggtggtgc

SEQ ID NO: 18873 - DNA, 1297 bp, Homo sapiens
agccctgaaagcatttgggttagcttccgcttactggtcagagttatactgtgcctgaattgatgcctcaggtcaggttgaaaaaaaaaaaggttcagacagcaattaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattggaaccagaacaggctgtaactgattatttttgctgtgattcgtgcttactggagcctcgggaaagagggagacaacatgtaaagagaagcaatctgtttggaaaatgaaaatacagttaaattgctaatgaacccttgtcaaaatcaaatgtctccccttagaggctgatgattgtctagtctaatatgcattttttttgagtgggtcaattggactctaagaccaacaagataaaaaggcagccttgcatgtcacttggaccacagctgtctggccatgcagcatgccttcactgctgctgaagaaaagcagctgcttgttgagaatctcaaattctcagatcctaattgcctggccctgactctaagctgaaacctgctactgtctgccttgagctgttttagcctcaacacgagctatgctgaactgaaagcaggcacaggctcaatgaccaggactcagacgttggggccgttggagattaaggaccccctccgtggagcgctaaactatgaaaacgtcctggaacctggctgaaaagggcttattctctaatgggaccatctaagatcaagctgctgataggctctttgtctctaatacagaggctaattgcattcctaacttctaatatttgccaaacgctccaagctggggaagggcacatcgcaaggactatgacctctcctcctgcttttgacagaccagactcaaaccttctctggggcttctctcactgctgttgacttgttgcattcagcttttgggattagttgcagcttgcaacagtggactgacagcctgactct

SEQ ID NO: 18874 - DNA, 450 bp, Homo sapiens
gagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaa

SEQ ID NO: 18875 - DNA, 812 bp, Homo sapiens
cttgcattatctccagctcctgttagtccagggccagcttctgagaatattccacaagtctagactaactcatcacaccaatctggagctaagcagtatctacagaaggcaatattgcttaaccttagcaatacaaccaggtatctaagtcatcaagaacaaagagacagtagcttcgaataccaaatattcatttccctgtattatccactcactggtttccttttaagaaccttcatgatccagaatggcctgtgattacttaaactgttaacaagtcaacagaaagtgatatgaaagcttgtggctgattgaaaaaaaaaaaaagtacattttacttgaatactaatacatgggttttgcatgaactgtcaagtctgttctttttgcagttggtacaatataacaaaatctaattcctgaagtgctcatttggggttacatagtttggctcaagggacagatgtcttagggcggaatcctggctccactatttaccagccctatcacgctgggtatattacttaacctctctaagcctcagtttcatgatctctagattagggttttatgagaatctgaaaatcttaaaatcaaaaagttataaaagtgatggtttagataagtgtatacaactccttttagttacaaggaaaagcaacatgtggggaagaaaaaactggtgttactcaatgtcctactatagcagacttcctcatgacatctgcaccagaactgaattttacctgtacttctgactctcaggttctcaggtataaaaagtcctatgcacttttttcatatgctttgta

SEQ ID NO: 18876 - DNA, 375 bp, Homo sapiens
aaccaaactcaacaggaagagcaacaggctcagcctcatcccaggctccgcagttgagcaggttccatggcacaggctgggagctcagcgagcgggatgagcgatgcactcacggtgccgcagggcatggggagaaggacggtttttcggagagggagtaacccgctgcccactgctcccctgcgtgtgccagaaaggcagcagcggaacctcggcctgtccgtcctggtttactcagggtgtggggtgtgcctgggaacccagatgtttgtctctcacacgtgctggttttgatggaagttacttgtgcgatgtgatttccacggatgcaggggaatggagcacgagaaacatgctctaggtaaaaaaaaaaaa

SEQ ID NO: 18877 - DNA, 444 bp, Homo sapiens
tgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggtcttggagtcagaaagtgcccagggaaatgaaaccaaatcaaacaaatgctcacaagtgtgcctgatagtgt

SEQ ID NO: 18878 - DNA, 137 bp, Homo sapiens
aaaccaaacaatggtctataaatggatcagcaggaagcaaagactagcaggaagcaagaaaatattcagaggaagcaaattccaaatgaggaaaaataaattgacatgggctcctttgtttaatttcactattatgt

SEQ ID NO: 18879 - DNA, 307 bp, Homo sapiens
ttttcctgcccagactctgaccaaaataatctccagcccaactgctaacccttcttcaggttttctgcttcagaagctctcttagaatgaagacacaacgccacacatctgaacaggaatctgcaagctggccttcacccacacctgctcctgctgcccctgggtttccccatctcagtgaaggtaccccagttctgcaaggtggaaagctgatgctgtctttgattcctcctcctcctcacccccacctcatcaaaacctgcccacgctatgtctaaaatatatctcacgtctgtcctcttcctct

SEQ ID NO: 18880 - DNA, 573 bp, Homo sapiens
  misc_feature (9)..(9): n is a, c, g, or t
  misc_feature (135)..(135): n is a, c, g, or t
  misc_feature (147)..(147): n is a, c, g, or t
  misc_feature (178)..(178): n is a, c, g, or t
  misc_feature (204)..(204): n is a, c, g, or t
  misc_feature (221)..(221): n is a, c, g, or t
  misc_feature (230)..(230): n is a, c, g, or t
tttttggtngagacggggtctccttatgttgcccaggctggtctcttaagtgatcctcctgccttggtctcccaaagtgccacagcacctggccctgaacattattttagtttagttgtttgagatggagtctcnctttgtcacctnggctggaatgcagtggcttgatctcaattcnctgcaacctccacttcccgggtttanacaattctcatgcctcngcctcccangtggctgggattgcgggcatgcaccaccacatctggctactttttgtctttttggtggagatggggtttcgccatgttggccaggcgggtctggaagtcctgacctcaagtgatctacctgcctcggcctcccaaagtgctgggattataggcgtgagccaccgtgcccggccttaaaacaaattcttaaaccggtattaccaagtcaaagaatgagcattttcacatctcgattaaattttaaccgagatttaaacatgtgttttcagaggtatgagtaatatgagtattccgggaaatataaaaataagtattaaaatgctgtggtttttgtttatattaa

SEQ ID NO: 18881 - DNA, 497 bp, Homo sapiens
cacatcactctgtgtcatgcttctgttacatctccttcttctgcctgactctgtcctctcctttgcccctgttgtaaggacccctgtgattgcatcaggccccctggataatccacgatcatctcctctatccaaagatccttcacttgatcgcatctgcaaagtttcctttgctgtagaaggtaacatatttgtaggttacggatattaggatgtgggcgtcttcgggggttgttattcagctactgcacggtcctgtggaggaattggtgcagttggcaaagaaagagacccccacgtgcctctagaggtaggtggctcaggagggcaaagctaaaccaaatattacagccttacctgttccaacaatgcctatttccttggaaatgagggaagaggcttcgagatgaaatttggtggcctctcccctcccccaaataatgtgacattattttgtgaaattgtattttggtgaggcccaaagagtcatacttgag

SEQ ID NO: 18882 - DNA, 390 bp, Homo sapiens
caaaaacacagtattacctcctaatcaaataaccaacacccaaagatacctgggtgtgactacatgtcaattcaagttcaccggagttaaaaggaaaaggtttcaccgattgtttgttggtgtttgttggaggctggtgtgtttaagatacagaagtagctgctagctttgcactaaaacaaacaaacaaaagcacatttcaattattttttatttattttttaaatttagtgcagcaaaaagagaacaaaggtggccaggcgtggtggctcacacctgtaatcccagcactttgggaggtcaaggcgtgcggatcacctgagatcaggagtttgagattagcctggccaacatggtgaaatcccgtctctactaaaaatactaaaaaaa

SEQ ID NO: 18883 - DNA, 628 bp, Homo sapiens
tcttgcttttctatgactttctcctccctggctgcatgccgaacttatttttttttaaacaaatcttagtatggaaggagaaccgtgactctctgaagctttaaaagagcactgaattatctgattcagaataaacaatgtattaaaatctaaaagatatgagaatttcttacaagcctgaaataggccattaagccatggatttaaacactgtggagcacacactgtgctaaccaagttgataaaggagagcacaaaattcaaggaaatagactataattttatatggcagaactgaagttttcatggaaagaaatctgtattttttaagagaaaactgtgattgaaagcaataaggatgacaaaaaggaggtacagggagtgtctgaaccgggttgaggtacagggagtgtctgaactgggttagaagcaggggttcggtcagtgcctctgggcagaaggcagcagcagcccacggccatctggctgtcactccaccgccccagcaccacgagggaccactcaagtgtcacccaggggactggggagatgtgtttatctacccagtagtgcagccccattttcaattttgctatgacaatttgaaatttttgaaatgtgttccaaa

SEQ ID NO: 18884 - DNA, 869 bp, Homo sapiens
ttttttcttgtaacaggcatgttggactttacacggtcataggtgacctaacaaagaatgtaagacgtaggtattttattaaaaagtctattgctcaggaataatgcatcctataaagttttaacttctttgttggagagaggttaagcaaaataatgtaagatgggtaaggtcagatgctatcttggcttggctggggtgtatagggcacattagaaaaacttaattgccttaactttttggttacattgctgtaagtattaggatgttgctggtgcagtggctcacgcctgtaatcccagcatttgtaagaccaaagccaggtgatcacttgagctcaggagttcaagaccagcctgagtgacatggcgaaaccccatctctacaaaaacattcaaaagtgagccaggcatggtggagagtgtatatagtcccagctgggaagctgggagtgtggaaggtggaaggatcgcttgagccagggaggtcaaggctgcagtgagctgaaattcgtgccactgcactctagcctgggtgacagcaagaccctgtatcaaaaaacaaaagtactttttaaatgattttcttgttaaattaccttttcccatgataggcaaatgtagtttatattggtttccttgtagtcattggtatctcgcctaccatttgctaatagctgagttgaaggtgctaaaaactctcagctgtattaatctactcttgctttcagaaagtaatatctaaatgaaaagcactactgcttgaataaagagtatccttagctaaattcccggagtagtttgttgagctgggggcatgccagagctgtgttaaactacaaaaatgtctgaataaactgatactcaaga

SEQ ID NO: 18885 - DNA, 322 bp, Homo sapiens
  misc_feature (10)..(10): n is a, c, g, or t
  misc_feature (31)..(31): n is a, c, g, or t
  misc_feature (66)..(66): n is a, c, g, or t
gacattaagncctgaggaggagtagctgttntcaggggataggaagtggggtggcctctgtgtgtnttgctgggattacaggcttgagccaccacgcctggccttatgtaagagtttttgtgtggacgtgtattttccattctcttgtgtaggtgtctaggagtggcactgctgggtcatgcgggtacagaggcaggttcttaactgcttttctatacctcctcctgtagtgagggaatttgtcatccatttggttcacatatcagtacttatttatttatttatttatttatttattttacttatttactgagaggcagtc

SEQ ID NO: 18886 - DNA, 256 bp, Homo sapiens
aagtggggaggagggcctgcctttcagagtgaagggatggtgcgtcacaaggagggggaggggcttcctgggtgaagaggtggggcttctcaagcaggggggaggagcttccaaggttaagaggtggggcttctcaagcagggaggaggagcttcctgggtgaagaggtggggcttctcaagcaggggaggagcttcctgggtgaagaggtggggcttctcaaggagaagaaaggggttcctgggtgaaggggtgg

SEQ ID NO: 18887 - DNA, 1124 bp, Homo sapiens
gaatagcaaaattatacagaaaaccctatatataatgaaaccttcgctcttaaaggatttcactaattcttccaattgcaaaataatccccattccaatacctttgcataggcttccaataataagtactacctcaattagaccttccaatctctaatccctaaatctttataagtttgcaagtgtaaatccagaaacccttttagcttgcctgtccacatgccccctttaaaacacgctgcatatctgtgattacattatattagtttctttttcaattaagcctttggaagagttctccctgtcgtggttgtagtggtcgcggtggtggtggtggtggtggtggtgatgatggtgatgttttaacggaaaataaaggggatcaaaggtggtgagatgcccctatgagaaaaccagctctcaattattcatcgacaggcgtcaagtgctacagtctagcagagaaaatacaggcagccctcagctttgtaccaagcacaatggcccccagaagtgactgtgaaagccacagagagatgcctttttacattgtgtatgagctctacaatagccccatgccctctcccacagcccaggaaggggagcctaaaaaaagaggcagtcttttgatttaaagaggacacagggcggcatctttcaggggtacaatgcactcagaccccacacacagtgaacttgggtctcgcttccaggaggaagcagcagactttgttctccatccttcactgctcatctctagggcagcccaacagctgcagcctgacccggatacacccatgagctcccactgaagcaagaaactctcttccctgcgactatttacacactttccctttctcctgccactgcttccagagccctctgagggtgaagctagggcaccattagcaactgagagactgaaatttaacctccatggcctataattttggcccgagcaatgcaaaacagaggagtttcaaatcccactacagagtgcctttaagctctttcttactttgcactttagtcgttcatgaataatcttacctcccattaaatgatgataatagaaacgatttccaaatggccccgagttcattttgagaaagtgagtttgaaac

SEQ ID NO: 18888 - DNA, 487 bp, Homo sapiens
gaatagcaaaattatacagaaaaccctatatataatgaaaccttcgctcttaaaggatttcactaattcttccaattgcaaaataatccccattccaatacctttgcataggcttccaataataagtactacctcaattagaccttccaatctctaatccctaaatctttataagtttgcaagtgtaaatccagaaacccttttagcttgcctgtccacatgccccctttaaaacacgctgcatatctgtgattacattatattagtttctttttcaattaagcctttggaagagttctccctgtcgtggttgtagtggtcgcggtggtggtggtggtggaaggaaaccttccagggaaagttgaggtttgcaccgggctctgaaggatgagtagaaatttgctggcggaatctgggaagggagaggaaagacattccaggtgaggacgcctgccagagcaaggagtggggcagtgaggagagtgat

SEQ ID NO: 18889 - DNA, 312 bp, Homo sapiens
gagagaattttaagatggagtggactacttttaaagctaactttaatagcaactcagaaaagatttcacctgaagtgattgaattgctaagtcacacgtgaaactgttctgtctttagattttatcgggaaaacttgttaaagctttccacacaaaagtacttaaacatacgtgtatcacattgtttcccattgcccaggtactgcctttttcctaggaaacactgaaaacagcttttcaagttcacttaaacatccattgtcatttaagaaaatattttctcataggagtgcagaagccttattggaagaa

SEQ ID NO: 18890 - DNA, 988 bp, Homo sapiens
  misc_feature (67)..(67): n is a, c, g, or t
  misc_feature (122)..(122): n is a, c, g, or t
agctttctctttccagaacaggattatgaaccgacaccatacagaggtatttgtaagaaagaaggtngatgccggaatcctttcttcaaacagaagcttaccagtaagtgcagactaatacnacaggcggtaaagagaagaacagagaaagcatcctgccccagccctgccccagagctaaacgtcattctagagaatgaaaaattccatctccacccagtgggttctcagaattccagagagattggaactacagcaaaggtatgaacaggtgtcacggggacacagaagaaagagcagttactcttccggaaggttggagaagattttgtgaaggtggggatgtttgatttgaaccttgaagaacaagcagagacccaagaagtacagaagaggggaggtggaaatagcatgaacgaggtggggcatgcaaattcactttcaattgatacaatctttcacgtcagagctgcttcttgtaacacagaagttttcagattctatgaaaaggtattgaatgaattgaaggctctgttaagggggcaactatctcccctccccattctcctatcagcccataaaacaggaactgacaacctcttggaagaattgggaaggaacttttcgattttctctgtacaatcttcactggttcctctctgtgagaggaggagggacctcttggattggtgtcgttgggaaaagggtatcaagtgtgcatggctcagcctgttcctggctctctctctgggactgacctgactgcaagcagcatgttctctgtctgctcctgcctcctccaggcaatgagcaccagggcgggtccagcccttgcttgggaggacttcaatagtccagctgctctgccgcgagtgggtgagtgagttcaagtcagaggagaagacacagaaagctcatttgggccttgggtcttagccacatcctccagtccatctggactagcaataaagctgacattttaatccct

SEQ ID NO: 18891 - DNA, 338 bp, Homo sapiens
cctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctat

SEQ ID NO: 18892 - DNA, 639 bp, Homo sapiens
ttgttaaaatttaggctctgttttctcttaaaaccagaccaacagtgtagtggagtagagagagcactggttttggagtcagacaggtgtgggcttggggtggcagctctgtgtcacctgctggctctgtgaccatgggcaagtggacccaccaagccttcattttccctatctgtaaaatggggtgaatggcctctactcctgggatcagatgagataaactgaaaaggccttggaaagcaggtggttgctggtagcttttatttcgtccatcagcattatcatgttgacatccctggtgccagggggagcccactgatgtcgctgtgaccagcaagaagagggcaaagaaaagctgtcctgtcttatggctgttagtgggagtatttcacggatcggtcctacagtgacatgtgaacttgctgtcctcccagttgagtccattcattcactcattcactcaacaggtctttattgaggtcctccaatgggccagatgctgttctaggtgctgggaacacagcagtaaactaaagaaaggccttgcttgaataccagttgagaagggaatcttggatttattcaaagtccttatgttgaagcttctctaaaaaaaataaaataaaaatgataaagggt

SEQ ID NO: 18893 - DNA, 504 bp, Homo sapiens
taggcttctagaacatcaaggttattgtttatcaaaaatattgtaaaattctaagtgattatcttttcaaatattttgttcaccctgccccctttgcccaataccaatataaaaacaggcaagtttcctgttctttttttcattcttaactcagggccaatacctagcttatatactcacctcccatactgatatgatttgcatttgtgtccccgcccaaatctcatattgaattttaatccctaatgttggaggaggggcttggtgagaggtgactgaataatgggggcatatgtcccccttactgttcttgtgatagtgacagagttctcgtgtgatatgattatttaaatatgtgtggcatgtctcccttcactctcttcctccttctctggcaatgtaagacgcacctgcttcccctttgctctttgccataattataagtttcctgaagcctccccagctacactttttgtacagcctgtggaagtatgagtcaattaa

SEQ ID NO: 18894 - DNA, 283 bp, Homo sapiens
tataatccccaatgtgttggtataagaggagtggcctttgtgaggtgagtaggtcatgaaggtggagcccttgtggatgggattagttcccttacaaaagagcccaaggaagtttttgtcccttttgccatgtgagaacacatcaaaagctccatctttgtagaagaaagcaagccctcactagactctgaatctgctcgtatcttagtcttgaacttcctagcctacagaacggttagcaataaatttttgttgtttataaattacccagtctaaggtattt

SEQ ID NO: 18895 - DNA, 585 bp, Homo sapiens
ctttttcatgtctttaattgaatgggatattggcccattttttcttccagtttattacactgaatattgacatgttattttccaatattgagacaatcaatgacaagactttaagagtaacaatgtaaaaatacagaagttgtctgagtttatcaacaatcccctggattagaaccccctaccagttctaggtcatctaatatatagacattgtgttcagtagaaataaatatatatattttttattatgctttaagttctaggatacatgtgcacaacatgcagttttgttacattggtatacacgtgccatgttggtttgctgcacccattaactcatcatttacattaggtatttctcctaatgctatccctccccctgcccccaccccccgacaggccctggggtgtgatgttccccaccctgtgtccaagtgttctcattgctcaattcccacctatgggaatacatttttaaatcatttttaaaggtgttattacattctgattgaacattttcagaaagaataaataatttaatacaagaagtgggccacttcatgtaaaaaaacaaaccaccactac

SEQ ID NO: 18896 - DNA, 1645 bp, Homo sapiens
gcctttctatcagccaagatggcaaattgaattgggctctttatgttttaagaaaaatttgcaggctttccccaatactgcaggatctgtgagtcatgggaggaacggatcaaagaaggagaaggaatgtatctaatcaggaaaccatacatcgtttttacttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattagatgggcctggtggcgcatgcctataatcccagctactcaggaggctgaggcaggagaatcacttgaatccgggaggcagaggttgcattgagccgagatcatgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggtttctggatgctagtttaatgatttaaacactagtggctcactaattcactagatagtttttgttctgttttctttttgctgcctgtttttatttttataattacattggcatgaatttccacttttcaatcttctaaggaatatttgagatttttgcttttaaaacttaatatttcctttaaaattctggaacttcttaagttgacattttaatttttttaaattaaattctgtagtgctcttacagaaccgaatattcttaatgtaagtataagcattacaaatccttgtagaataaatatttttagcattgttacgaaggttaaaaactgggttttgttcacttacatgtcttaaaattgccttaaaatgaatacagaaatttatatggcagcttctagtacagttgactgctttaacatggcctgacatctagtgatatttttctctctttcaaatttctgttttctagctcttaaatatctgtttctcattcttataaatcaagatgcttgtagtatataattctgagactaattatctgcttttgaattttttccactgcaattcatataatgtgaagatctgtgaaaatgctatgggaaaactagcttgggttcaaaatatcttaaccaaatataccctgtaggcttcccaagagtgactgtctgacagttggtgactgtagaagaagctggttgggtgttttctgggccaaggaaatttaaaatgtctgcaatgttatccatcattactttttgctgtcagaagggatggcagattgaagcttttctccctatcgcattttcagagttgccgtgtcagagcttcaccttgggtgaaggaagatgggcaggaattctggaaacagaactcctgagacctacctctgcctgcctaaaaatgtggactgactcagtatgagaaataacaagaaaacatttaagtgtttggggcaaatgttaatcactttctttccatagggc

SEQ ID NO: 18897 - DNA, 412 bp, Homo sapiens
tcccaagtatctggaattacaagtgtgcatcaccatgcctagatgatttttgtatttttagtagagatggggtttcaccacattggctaggctggggattctggtacttttctaatactctaacaacttcaattcttaatggtacaattattaaacccattttacatataaggaaactgaaggacagatagattcattaactttgcacaagattacagagatagaagacatcagaggtacccgaggtgagatagtttatttccagatcctgagatttttgagagagaatctccatgtttctctcatgttgctgcaaatcttataaacagatgtactggctgtttttgtgacagactatcttttctagaatgtttgtatagcaaacttccttgaaaaacagagattgtaaatc

SEQ ID NO: 18898 - DNA, 787 bp, Homo sapiens
gtcctaacccctatcaagatacagcacattctcgtcactgccagaaagttgccctttgccccttcctggtcagtacctgctcccagaagcagtcactggcttgccttgtcattgtgggtcagccttgcctcttctagaatttcacagagggggagtcctgccccgtggagtccgttgggttgagcatcttcggctcagcatgatccttttgagatgcagggatgttggtgtgtgtgtatcgggagtgtcttcctttaagaaattctttcccgtgagtatttcttcaagcctggatttctcatgaggctccaaactgcagaagatgagaagggagggctgtgtttcctgtgttctcagctcctggtgtgcagtaggtgctctgtagatgcttgttgaatgaatggatgggtggatgacaggcatgtcccagggatggagaaaggggagcagagaccctgtctttggagttcctgtgtgtttctcaaaaagtgtcccactggccagggcgcagtggctcacacctctaatcccagcactttgggaggtcagggcaggtggatcacctgaggtcgggagtttgagaccagcttgggcaacatggtgaaaccccgtctctacaaaaaaatacaaaaagtagccgagcatggtggtgcatgcttgtagtcccagcaacttgggaagctgagaggtgggaggatcacttgagcccagaaggtcgaggctccagttagctgtgatcataccactgcactttagcttgggcgacagagtgagactgtctcaaaaa

SEQ ID NO: 18899 - DNA, 661 bp, Homo sapiens
gtcctaacccctatcaagatacagcacattctcgtcactgccagaaagttgccctttgccccttcctggtcagtacctgctcccagaagcagtcactggcttgccttgtcattgtgggtcagccttgcctcttctagaatttcacagagggggagtcctgccccgtggagtccgttgggttgagcatcttcggctcagcatgatccttttgagatgcagggatgttggtgtgtgtgtatcgggagtgtcttcctttaagaaattctttcccgtgagtatttcttcaagcctggatttctcatgaggctccaaactgcagaagatgagaagggagggctgtgtttcctgtgttctcagctcctggtgtgcagtaggtgctctgtagatgcttgttgaatgaatggatgggtggatgactccctagtgccctcaggtaaaacctcttcagctccgtacaaagtctttctgatctggcctggcttatctcctacccttttcatcttgcctttcactcaccaagctggttcccgcctccccacctcggcctgcactgtactctgcccagagtcatcttcccctgctacaagcataccccagagagcaggcaggttaggttctagacagtgcagtaaagtgagtatcacaatagagcgagccacac

SEQ ID NO: 18900 - DNA, 444 bp, Homo sapiens
ccagatgagaagttggagttgggggtcaaagaaagccggtgtcaagcttgagctgcatcaaacagtccaggatcatttaggcagcaaggaggtcaactggctactaagagcaaactctggaaaaaatagtcaggaatcacgctgggatttcagatcaaaaccaactatagcgatctgggggtaccctcagacaccatggccggaccaaccagtctccaaataacttggggtataatcagatcagatgctcaacgctatgtctgacatccctcctccagtgaaacagagacagtggctgtgaatttttcccaattcctatcagtttcagattacacactcaggacagggaaaatgtgtcacacgctgtggaatgaatcgtaaaaggggaaagaggactctagtgggctaaactgtggccctcaaaagatatgtccatgtcaaatc

SEQ ID NO: 18901 - DNA, 361 bp, Homo sapiens
gtatgatatatatatacacatacacacacacacacactttaaacacacttttttttttaaacaaaagggaagagtattagccgggcccagtggctcaggcctgtaatcccagcactttgggaggccgaggtgggtggatcacaaggtcaggagatcgagaccatcctggctaacacagtgaaactctgtctctactaaaaatattaaaaaattagccaggcgtggtggcaggtgcctgtagtcccagctacttgggaggctgaggcaggagaagggcatgaacccaggaggcagagcttgcagtgagccgagattgcaccgctgcactccagcctgggcgacagagtgaaactctgtctca

SEQ ID NO: 18902 - DNA, 394 bp, Homo sapiens
gcagatgccagtcttcttggcctacccttatcacaactccaggcgttttggggcaagcctttgtctgtacgctttaatactgtctgtgctctgaataagttcagagcaccgtcaaataggtcttgatgtccatgggaccaacgctaaatactggtgtttttccagtttcttagcccaggactgattgaaaagttaatgtttatttttcttttctttaaggaaaaaactgagaatgggaagatactgacaagtaaacagttctttcttaaaatgcagcattatctggttctctgtcctacatctggattaaaaacaagtcagaagaacctgggagtaacttgcataagtagacataggggaaaagcaggaatgccgtttgatagagaaagaaaaa

SEQ ID NO: 18903 - DNA, 234 bp, Homo sapiens
tctaattatacttgacagaatgctgtggtggagattagtgctaagtggttgcctgaagatcagtgcagtgaaaatgttacagctgtgattggaaacgtaaccctaactgtgataacagcttcaccttcttcgcaggttttaaagtgctgtttgcctagtcctattttgaatgctgattaaataagtttgaattggttaaattgcttgttttctcctcctttaattgtttaagaa

SEQ ID NO: 18904 - DNA, 435 bp, Homo sapiens
aaacgtgaactcagagatgttaagtaacttaacttgcccaacacatacttagtaattagcagaattgcttttagcgcagagcccttctacacagccctgaggaacactgtccttaaaccacaggactcgctggtagcacctgtcctcagtagcgtgtgggtttccctagcatctcccagaaaacagctcactggattggctcaggtgtgtaagggtacctggatatgtgagcagggcaggggtggcagaagatggaagattcaggaacctaggggtgcctgtccatctttgttcttgaattatattatttcctctggaattcctgcttctgctctctccctctttccttctgtgagcaccctctctgggtgctcaaactcctccttgtccccagctacccccagtcttttactcaggcttaataaaacttgtcct

SEQ ID NO: 18905 - DNA, 500 bp, Homo sapiens
caggtcacctaggtgactgaaagctgagccacagactgtggtaatgctcttctgttcatccttatttctagggttcaaccattcagggtttcaaagcatggtttggagttaccaggcccttacctcttcactgaccctggactctttttgaatctttagccccttagctctatctactcaacttcccagtggccttttgcaatctataaatactcctaacacagtggtcccaaatgaatggttcatttttctgaatttctatcttttctcagatattattggcatggtaattattcaccaacttatcagctccctgctgccttcctacatctttgaaaagtatattttatccagcttttctaaatgttttcaagtgagaatgttaatccaaattacttagcccacattatttcctgttgattatgtgtaaaatacagttggtttatttgtattgtttttgtacctggaaacaataaactctgtagtgattctctaaacta

SEQ ID NO: 18906 - DNA, 215 bp, Homo sapiens
ggaaagagaatggggaaaattgatgttagtgggaccctatagaggctgttctgtgaagtatattgatttggaaggtaggtgttgcccatagaattggaaggggcacattcaccaggagtaggagtgaaaaagaagcctgaattggcagactaacaggctgctaactgcatgttggaaagtggtttctaaaccgtgggtagaggaaagcccccatt

SEQ ID NO: 18907 - DNA, 383 bp, Homo sapiens
atcaccaaatactgagaaatgtttcagcatgcttggcgaccttagattttgctggacctacaatggaaaataaagttgtaggatatttttgcatgctggtgatttttttccttttggttttttttgtttgttttcaattttatgggggagaacatgtaaaaataccttaaccaatgactttaggttctatattattgtaaaacaatttacaataatttgctcttcacctctctcatgccttctgtgtaatagacagaacaataacttttggaaaaagagctaggttcagtttccacttctgtcaccagctttatgacctgagaccaatttgttatctgagcttcaatgttgttaatcaattaaacaggcataatgctaggttc

SEQ ID NO: 18908 - DNA, 124 bp, Homo sapiens
gatataccacttgtaggatttttttatgttattataatgtcttcatttcttcctacagtctagtaatatcttactcctttttcaaagtccagtttaagacctgtttcccctgtgaagtcttttc

SEQ ID NO: 18909 - DNA, 234 bp, Homo sapiens
tgagccaccacacccggtcggatcattttttaaaaactaagtcgaggtctcactatgttgcccaaggtggtcacaaactcctgggctcagtccatcctcctgcctcagcttcccagcgtgctgggattaaaggcatgcccagccagcatcttttttttttttttttttttgagactgagtcttgctctgtcaggctggagtgcaatggcgcaatctcgtctcactgcaacctcc

SEQ ID NO: 18910 - DNA, 418 bp, Homo sapiens
tctagtaagatcttcctcctatccttgaggctgctcaaaggtcaactcctatgtgaaatttcccaactcctccaggcaaagttaagaatcctgtgctttgtaataccataccatagcactgcatgcttgccacatctcatcaccctataactattttgatatcttcctactattcatcaataaagatggaccagctaagttttttagaaggtaatatacattttagtttttaatacatttcttaagtgcagaaatttgccttctgtcaaatgtcatggttaaccaaagacaagtgaatgtaatttaatctgtcactggtaattataacttgaactaataatgaatacatttcaatagtatataagaaatattcaagaaattgccttcccaatgttgataatactagcagtatcatgca

SEQ ID NO: 18911 - DNA, 297 bp, Homo sapiens
ctagataatatcaaatatgtccaaagttgacattccaatgagatctccagggtttgtgagctgttattgttccgcgaccacactgatattcatatttccagttgtttactaaagggctaataagttataaatacattcatttgcttttcagtctagtgggcacgtgttgccatgactttattttgccttcccctgattagtttgttagtcatttttatcctctctttctaagtatctgttcctatatttttgtctaccttttggggttgcttgtctttttattgatttgtgtgagtt

SEQ ID NO: 18912 - DNA, 792 bp, Homo sapiens
ttgagaaccacttctctaagagttgtaaaatagctctaaacacttggggaaattgattacttttaggaagataagctgtgtctttgaacaatttttagtggctcaaccatgtgcttgccccttggggcaagtgtggaatcaatctgatgcgctgtcaccggtaaagctgttccagtacacacctctccctcaaagtgccctacacagccccttgctgaatcctttgcagcagtgaaaatcgggggttggggggaggcaagagtaggctgtgcttggggccatggaattatgcaggtctctaagggtgtggaccgaggagaacataaaggaacagtgatttaaacctgtaataaacagatgcccttgaggggaagcagcccccacagtaccctgctgggatgacctcccgcagcgcaccccactcacatggtacccggggagctcacactgccacacttgcggcatgaggtggatttcttcatggggataagaacctgtgcattgtggtcctcaccagggcccaagtggtaatcttttattaagagcaacaggaatcctggtatgtagaattgggaccgtatcttaagtgtttgaaaccatactttcttttttactgagacaagaggagtccatcaaaggtagtggtttaggagactttatgtccagccattaaatagagaacaataaacctcacttctccttcacctcgataaatgattttatgtgactgtttctggttcctggcattcatttggagagttgaaatttcccacctgagttgcccaccaaggt

SEQ ID NO: 18913 - DNA, 445 bp, Homo sapiens
ccaactcaaatatattaaacacaatggattcttgatttaaaagaaatactattgattaaaaaaaataagaattattttacccagaggaaaaatatcttatagaatcctttgattttctgttttttacctgtcctggaacatttttatagactttagaagactattttattgaaaaagtagaagacaaactaaattaaataaatctgcttaagattctgggctcataagcaagaaatctgaaatttacgaagaaatgtatttatccagaaactctgggcaatctgaatgcctgggcaaaaagagatgagaattagaggagtgcctgaattacttgcacaagtgagctgtctgtagtccccaagtaagctatggcagcatgttattacagatattagaagccttacctaattcatttataaagagtagatacatggcaggaccagca

SEQ ID NO: 18914 - DNA, 549 bp, Homo sapiens
ctggagggatactttggaaggtattctccacttcagcatgtctggtcagggagtctagaacattgaacaaaatgcctgcactcagtcagaaataaactcacaatcctttaccgcttgcccgatactctcctccatggtgctcgaaaccttgcgtgcaccttcccctggtattgttgtgtttacttgggacttggtttgctgtattggagatgtgtgttttgatggactcagtcttaagtagagatgagtatcttgctggtggaacttaaggacaggaagaagattgttttcggtttagaactctagcctttgtgtaaagtatagcaaagcaaagtcaacaagcaaaaagttgttagtttcaatgaactaattgagaatttgagaatcagaccatagctgagcagaaaatgaatagaagtaacattgacaggatgaggttgcctagctttttaagataaagctttggccgggcgcagtggctcacgcctgtaatcccagcactttgggaggccgaggctggcggatcacttaaggtcaggagttcgagac

SEQ ID NO: 18915 - DNA, 283 bp, Homo sapiens
aaactgagagagaaactattgattatctagcccaaccttttatagctaaatgaccttgaataggtagccttttcttttatctgtacaagcttactgcagaatctcaatttgtgtgagtgacagcaggtgtagcagctccatctgtatttgtcagattatagtttactaactgaatgaactaaaaattgggatatttggggcttgaatttttattctgaatgtacagtctgactttatccccaccggtaaattagaaattataatctcagccctaattctactg

SEQ ID NO: 18916 - DNA, 405 bp, Homo sapiens
gttataaaggtgttcactgtaaaaaagctttcaacttactggcttttttctggagtatgtgaaaagaaatgctttcaactttcctatatgtctgaaatttttaataataaaatattgggggaaatgagttgaaatatctggaaaaataaaatttagataatggctagagaaaattttcatggatttgggattcaacataccacccccagcctcattattatccccattgtgttcaagctctctcttcctcgtggcttattcattcggtcttgatcatctctggccatcatgttctaagtgatgtggatacgatggtgggacaaggtggctctctgactgtggaacatgcatcctttcacttttctgggggagtggagacagacaagcaatagtgagatgttctat

SEQ ID NO: 18917 - DNA, 397 bp, Homo sapiens
ggactaactggactagatccagatcaaccgcgggttactgtccatctcctgtgctggatcccattggcacaggttggaagaataaattgcggaagtgccactcccctcctgcgtatcaacaacgctttgtgggcaataatgaagaacacgtgtgttaatcccagcctccaagttaaaaaggaacaaatatcaatcacttcgcggatatcaaaactattaataaacgtttaaaaggccgggcgccatagctcacgcctgtaatcctaacactttgggaggctgaggtgggaggatggcttgaacccaggagtttgcagaccagcctgagcaacatagcaagacccccaactctaaaatacataattaaataaatgaataaatataccttacatctttc

SEQ ID NO: 18918 - DNA, 374 bp, Homo sapiens
ggcgcaatctcggatcactgcaacctctgcctcctgggttcatgcgattctcctgcctcagcctcccgagtagctgaggtaagaggattatttgaggccaggaagctgaggctgcagtgaaccgtgatcacaccactgtactccagcctgggcaacagagtgagaccttaccttaaaaaaaaaaaaaaaaaaaaagtaaaagaatcatgttttcctatctctatgtttccagatggatccatttctacatgcatttactatcaacattaaatctctgccaatgatgcgtttaaatcccaacaaacctgaaaaaccaaatacttcaagcccaatgccaaagaagagcctatgagcatgccagctgtttgcctttt

SEQ ID NO: 18919 - DNA, 329 bp, Homo sapiens
aagtacaaaaatgccattaaacaataatgggatttgtatgtgaaacattatactctttgaacattttttagaaagtcactcttctctttccccttcgactaataacaattcaacattatttaacataatcctactgacaggtaatttctgacacgaaatttattactggcttgccctttgagggcatgtttcactattaatgtttccttttaaaagctatagcatacattagattctcatacagagtttcccccatgttttccttggaaacccctactttctgtggtattttacattacccaagtctgctttaactgtatccttacaca

SEQ ID NO: 18920 - DNA, 403 bp, Homo sapiens
agtaagatgctagtttaacccaagtagatcagtaattaaatgtaaatggactaaatctcaaagatttctatgtgttctccaggattccatgttgcctaggcagagagccaaatcaagaatgcaaatgatagtctctagaataacccctgtgagactcgtagaatagcagataacctccacacttgtggagggggcaggtggggaaggaattttttaaaatatggcaaagaaggaaagaaacagcaacactgaacatggagaacacatagaaatctttagtaagatgctagttttaacccaagtagatcagtaattaaatgtaaatggactaaatctcaaagattctcaaaagtgaaaaaaaaaaaacagaacaaagacataagattataaaaagattaagagt

SEQ ID NO: 18921 - DNA, 538 bp, Homo sapiens
cttagaatgcagaacttaatcctcaactcttgagacctggttaccaattctgggacagtaggaaaaattcctcttattctctcatagtaataagtgactccactgctgttactaagccaatggctctcatcacactcaaaatccacacccctcatcacaacctccaaagccttgttccatcaagtcccagtctacctgccctacctctgctctgctcactctcttatccctcactctgctaaggtacattaggcatctatctgttcctaagcacaccaagcttgttcccatctgacagcttttgcaccttcagtttcttcagcctggaattcttttccccttatgcacctgcagttgttttgttgttgttgggcttttttttttttgagacagagtctccatctctcacccaggttggagtgcagtggtgcaatcttggctcactgcaacccccacctcccaggttcaagcgattcccctgctacagcctcccaagtagctgtgagtacaggcgcacgccaccacaccctgctaattt

SEQ ID NO: 18922 - DNA, 424 bp, Homo sapiens
ttccttccatgatatagatatattgatcatgaggagagggctcacccctcacccggagaagtagttggggaagcaatatgcggaaacaaagccatgaatctgacaagaaatgtacttaagattgtatatatggagatgaatacccattgtcctttgcactttctggatgataaattagaaaagaaaaatccaaagaatgaagttgtgctatttgtcctcacttctgatttgggaaactagaggaaattaagatgggaaaagaccatgtgaggacacagtgagaaggagaccatatgcaaagcaggaaggaagatctcactggaaccaaaaaccagccctgctggcaccctgatcttggacttctagcctttctcagaactgtgagaaaataaatttctgatgtttcagccaaacagcctgtggt

SEQ ID NO: 18923 - DNA, 432 bp, Homo sapiens
gaattacttcaggagattcaaactttcattcagttatgaaacaatgcagtgttttactttataaattataaccaaatattttataataaagatagctgacatgaattgaaggagaaactgttttatcctcattttatatatgaggaaagtaaaagcccaataagttaaataattactcaagaaatggataagccagtactcaaacttaggaagttggccccaaagcccatacttatactatactgacactactgacagatatcactagttacctaaacaagaatccatgccacccacttcctttgtgagatcccatctgtgtgacattcacgttcttagtctctctaaaggcaagaatggatatataacctagttctggccaatggaattagaagaaatgccttctaggtctttcattttgtaccctggtga

SEQ ID NO: 18924 - DNA, 3230 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18925 - DNA, 491 bp, Homo sapiens
ggaagcagctatggcatgatcgaggatttaatgcgactcgctatagggaatttggcccgcaaggccaagaattcgtcacaagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18926 - DNA, 636 bp, Homo sapiens
tcactctgtcgtcctggctggagtgcagtggtgtgatctcggctcactgcaaactccatgccccaggttcaagccattctcctgcctcagcctcccgagtagctgggactacaggcgcccaccggcacgcccggctaatttttttttgtatttttagtagagatggggtttcactgtgttggccgggatggtcttgatctcctgacctcgtgatccgtccacctcggcctcccaaagtgctgggattacaggcgtgagccaccacgcccggctcctctcttttctagaaggaatgttctccttctcaaaaggaaggtttctcctttgtgcttctccaaatgcaacaacaggatgtgtgtgtggtaaagggtgggaacactcagggcaatgatgtgctccaggtgagcagaagggagagaggttccagaaccttctctgccaaatgttcctgggagcaaatcagagccagccaagaaggggaagctgttagagtctctcttaccccattatttccaccaaaggcaccgaaaaagaaagggaagaaaggcaaagccaaaggcaccccgattgtcgatgggctcgctccagaggacatgagcaaggagcaggtgagcagagcgggctgtggcccagtcc

SEQ ID NO: 18927 - DNA, 523 bp, Homo sapiens
cctgaactctatggaacgtgtagaatggctgcgtcaaaaactggattaaaacagccaaggcatgcaagagaaagaacatggaagtttccaaggccagtggacccactcagaatcccagaacaacctatttccataaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggtgctgtgcgtgggctgggctggggaggcacactctgcctgtcctagaatgtgggctgcagagtcctggggatccagaccccagctctccaccccaacacacccagtactttttataagattgtttgacaatgcccctctcatatccttaactgaaattcctaaataacgtaacctatctcta

SEQ ID NO: 18928 - DNA, 484 bp, Homo sapiens
gagtggggaggaggcctcttcaggaagagcagtttatttttgtgaaaggaatacttactgatttcaaacatttggaactaaactggaacgtatttttctttccgatttctgcgtttttgaggtgtgtgtaaacccaccagcgcagcagctgggagggcccttcaaaggtgggcgggtggggtgagtgaggcccaggggatagagtgtttgcccagatttgaatctcatttggggaaagtttcagaggcttgggtggctgattgatcattccttcaatggtccttcatcagcacgtctttactgagcacgtgctgtgtgctgttctaggcgctgaaggatagaagtgaagggttcccccctcgtggagcttaggttccagcaataagcaaaacatgccctgcagcgaaaggcttctgggctgccggcgacattttcccaacgttcacaaccgggttccttccggacgcccgtctctagggacgca

SEQ ID NO: 18929 - DNA, 437 bp, Homo sapiens
atgattattggccaaattgaagagaattctgccacctgctgaatgcattctgtctccggagcttcctagccttatattttaactttttacatttagctgtttatttttaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctgaggcaggagaatggcttgaacccgggaggcggaggttgcagtgagctgagatcgcaccattgcactccagcctgggcaacagagcaagactctgtctc

SEQ ID NO: 18930 - DNA, 3226 bp, Homo sapiens
gagtggggaggaggcctcttcaggaagagcagtttatttttgtgaaaggaatacttactgatttcaaacatttggaactaaactggaacgtatttttctttccgatttctgcgtttttgaggcaccgaaaaagaaagggaagaaaggcaaagccaaaggcaccccgattgtcgatgggctcgctccagaggacatgagcaaggagcaggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18931 - DNA, 3161 bp, Homo sapiens
agcggccgcgcccgctggcgtcctcttgttctcttccaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18932 - DNA, 2784 bp, Homo sapiens
ttgccctcaccgtagtgcagagggggaagtaatgaagtgtgttctggtttgtaaaagctcagatggaaccgcagtgagggccgtgatgtggctggagtggataggtgtcatagtcactgcctgcgacaggtggataggtgtcatcgtcactgcatgctggcagtgacaggattttctacagtagacaacggcccttggtggaatcttgaacaaagtatagtccttcagtctgcatggaagctgcattcccagaaaactcagaataagttgaagctgcagaaatactgtttatacatagaagacgtctaggtgccagcatgcctgaggctggcagcagctggtgatgggcaggagagcacccagctctcaccatgcaggccacagcccctttggttctgcctgctgagcccctgccgggcctgtgcttgtgcctgcaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18933 - DNA, 2255 bp, Homo sapiens
gcgcaggcagtgtggacaacacactgaccccggtgctgtgggagtgggcactgttgggaggcagcgtgttccaggcaggtgcagaggtgggaggcagcatcttcccagcgagatgtccccaggtgaggggcctcatcgcccacccccagcgctgtccctacaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18934 - DNA, 2700 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctc

SEQ ID NO: 18935 - DNA, 810 bp, Homo sapiens
agcggccgcgcccgctggcgtcctcttgttctcttccaggcaccgaaaaagaaagggaagaaaggcaaagccaaaggcaccccgattgtcgatgggctcgctccagaggacatgagcaaggagcaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataaaagaagacagttatctcatatttggctgccagctttttatctctctctcgaccacttaaacttcagacttctgtcctgctggtatcatggaga

SEQ ID NO: 18936 - DNA, 1445 bp, Homo sapiens
gatctctcagaacgcccactggagtccccaggccgctcccgttgcctcggccaaaagatgagtctcaaactcccatcacctctctctcctcaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctc

SEQ ID NO: 18937 - DNA, 987 bp, Homo sapiens
gctctctctctctctctctctctctctctctctctcctgagtgtgagcatcagcagaaaaactcagtctaaacccctttgttcttctcttgcagagcttttgcctgcaaggctgttctgaccacagtgggcgttttgggcccgtttacaggctccatgttctgtagccgtaggggcaccacgtcttcctctgctaagctgctgtttgctgctgcctttcagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgagtggcaccacgctggccctgcagttggcggtgggtgttagagcaacggttcaccaagttcaccaaggtgagcgggcactaggctggccctgcagtggggatggcacccctgctagccagggacggggctctccttgtggcccctggaccagcttcagatgccttggccaggtttctgggttctgaagctggaggccctgttccctgtaactcattccgcagcttctaagaggcaaaaacctgtggcctgttctgcatgcatattctgcagaaggcctggggtcttgatggggaacggatca

SEQ ID NO: 18938 - DNA, 3144 bp, Homo sapiens
agcggccgcgcccgctggcgtcctcttgttctcttccaggcaccgaaaaagaaagggaagaaaggcaaagccaaaggcaccccgattgtcgatgggctcgctccagaggacatgagcaaggagcaggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18939 - DNA, 3248 bp, Homo sapiens
agcggccgcgcccgctggcgtcctcttgttctcttccaggcaccgaaaaagaaagggaagaaaggcaaagccaaaggcaccccgattgtcgatgggctcgctccagaggacatgagcaaggagcaggtgaagttgagtcctccctctttcttccttgcctttcgccggccacacgccccgttgccgtgcatgggcccctgctcagtgcctcacctgacccactgcacctggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18940 - DNA, 2705 bp, Homo sapiens
cccccgccccatcagagaggaatttacctccagagcttgttaactcagggagcaaaaactggattaaaacagccaaggcatgcaagagaaagaacatggaagtttccaaggccagtggacccactcagaatcccagaacaacctatttccataaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18941 - DNA, 1886 bp, Homo sapiens
agctgcactcagctctggtggtcctgagcgtggggaccctcagctccctgacactgccctgtctccacaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataacctgtggttttcacttaaaatattgtgtatggctgg

SEQ ID NO: 18942 - DNA, 1443 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggccaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgagtggcaccacgctggccctgcagttggcggtgggtgttagagcaacggttcaccaagttcaccaaggtgagcgggcactaggctggccctgcagtggggatggcacccctgctagccagggacggggctctccttgtggcccctggaccagcttcagatgccttggccaggtttctgggttctgaagctggaggccctgttccctgtaactcattccgcagcttctaagaggcaaaaacctgtggcctgttctgcatgcatattctgcagaaggcctggggtcttgatggggaacggatca

SEQ ID NO: 18943 - DNA, 1944 bp, Homo sapiens
ggccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcatccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaaaacttg

SEQ ID NO: 18944 - DNA, 857 bp, Homo sapiens
ggccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatatt

SEQ ID NO: 18945 - DNA, 593 bp, Homo sapiens
ggccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaaaacttg

SEQ ID NO: 18946 - DNA, 482 bp, Homo sapiens
gatgtccaggcatccaaatggcaggagttctctggatctgacctcaaaagctaggcctgaaatgaatacattgtgggtctctctggggttggaaccaaaacctcatttttttttttgttttattctttttattttcttacaaagaagagtttgtaaaacaaaaggcaatctgaaatctggctgttggtccaagaattaacaagcaatctgttgtgctaatgacatcgactgttgaatagatttccaaagaaaatgacccatggggagtaggatgaggttaattcacagaaagccggcttccttgggattgtctgcatttcttctgaaggaaaatgtctgaaagatgctggtcttccctcaaagtctttcattcccacagacagccctgccagttcctgggctcccacaggagccaaactgctgtggaggaagaggtgaattgagatacggagaaagggaagaagaaaatctcggaaaagtgt

SEQ ID NO: 18947 - DNA, 271 bp, Homo sapiens
gtcttccatatgaaattcttctctgagcattaaaatgttaatactgatttgctctttaaggaaagatttctgaaggaagcattaatttggtcaattcctgtccctaccaatgacttgcattcctttctaccctaagagggtctctgtagtcgttcagcacttttcagttatcggcagtaacaacaatgagagctaccgtttatttattgtctgctaggcactttgcacgcagtatctcatttattaatagagaactctaggaaacaagtgc

SEQ ID NO: 18948 - DNA, 432 bp, Homo sapiens
cttagactacaaagaattatttggcttttaagagtcatggtttttagtccagggaagtgacttgatgtggtttatatggcaaaaggagcatagtccgtgagactgtagactattgttatgaagatcacatgttcacagagtgctggcttttgttgtgttatcattaatgctatttcatagaatgaatttattttcctcattgccaacagaaatgagataccttgctatctggcagaaaaataaccgtgcgactattgaagttacatgctctgtgaataaaatctaacaacataaaaaccataccaaacattattttggtattaatagctctgtgatatcatactagaaattggggctaggcatggtggctcgcacctgtactcccagcacttttgtgaggttaaggtgggaagattgcttgaggccagaagg

SEQ ID NO: 18949 - DNA, 445 bp, Homo sapiens
tccatcttcaccgatgccagcggtatgctcgggcaaaccaccaaagcgctggttaatttatgggaatttaacccatcattggctctcaacaataaccaaaggagatcatagcatttcattgaagccagaaagctgaaacagcaagtctgtgtggttaacgaaccttgtttaacagtggaggctcacgtgtttgaacatttactgccaactagagttttgccccttttgcaagtctgctgccagcttcctaccactcacaggcgcgctgcttcaagactcttggggtttttgtaagaaacttgaaatggcaaatcacaagataggtttcaataaccaggattattctttacgttaagttatatgtatgtgatctgtaagttggatctttcatgatgaatttgaactaaggcaaaaataaaattcctctcctctaaggactcatgca

SEQ ID NO: 18950 - DNA, 447 bp, Homo sapiens
cccttagtccctgcacccaggcgtttaaggatacagtgagctatgatggtgctacctcactccagcctgggtgacagcgagtcagacgttgtctcaaaacttaaaaaaaaaaaaaaagttaaaacagaaaaagggcttcttgtcagagactgccgtatatctagaggtccaggaactaaaaagtctgatgtccaatcctgaaaagctcgatggtgcactagaggaggcttttacatgtaagagcatctaagttctggaaatgccagtgtcagggaagggaagtggagagcaatttggcatccaaacataacttgctgatacttttttttttttaacacaagtactacattctagtctttctgtggtgtcattgtaactattgtttcttaatatgctatccactgacttcaagggatcaataaataggaatcaaggtgtcccagaaaa

SEQ ID NO: 18951 - DNA, 445 bp, Homo sapiens
aacatcaaataaaatcaaatcgggctacaattcaacaagcttcagagtattaggccttccactgagtggccagggggcttctagaaccagaggcattcaaacagccctaaattatcaaggaacataactatagacacaacagagactcaaaactatggcaataccatgaactccatgctcataaatattcatttattaagtaaatacatatttatcaaacatatctaagtatataaaataaatatgtccttgtattttttgttaattacatgaaacaagttcttagcaaaatatatcatcaaattgactaaaaaagaaagaaaacacctaaataatgcagtcactactaaaattgaatcagtagctaaaacttctcagaaagaaaacctcatgtccaatagttttatcaacttcaaccagactttcaattaacaaataatagaaa

SEQ ID NO: 18952 - DNA, 375 bp, Homo sapiens
tgagaatgaaaaagacaaataatgtcttagtttataatacaaacagttttgacttcagaccaaactcctcatgagacccactgggttaacacaatgcctggcagatagtaagtaatcaatatttgatagcataaaaaataacagtatacgtaattgataatacgtgtaaatctaggtgaaaaacaatagagaaaattaaataaataacacaatttatctttttttttcttttaattatgctcagaaagactagaaaacatccaaaatgataatggtacttacatataggtagtttgactaaagtgatttttccttcttactatctttctgtattttgaaaatttgctataataaacagatagtattttcaaaagg

SEQ ID NO: 18953 - DNA, 618 bp, Homo sapiens
tgagaatgaaaaagacaaataatgtcttagtttataatacaaacagttttgacttcagaccaaactcctcatgagacccactgggttaacacaatgcctggcagatagtaagtaatcaatatttgatagcataaaaaataacagtatacgtaattgataatacgtgtaaatctaggtgaaaaacaatagagaaaattaaataaataacacaatttatctttttttttcttttaattatgctcagaaagactagaaaacatccaaaatgataatggtacttacatataggtagtttgactaaagtgatttttccttcttactatctttctgtattttgaaaatttgctataataaacagatagtattttcaaaaggataaaaagcctaaattccagttttctggcctacgtcatacgaccacacatcccataatctgccccttctgctccaacacctgctctgctgaatatgcctaaaggaaaattacacaacacacatttggttcctccacacattctccatctcccaggcctcatgtaccctggaaatctcgtttccttactaaactttctcttccattagccctaagtggctacatcaaagcttctcctaactctt

SEQ ID NO: 18954 - DNA, 305 bp, Homo sapiens
acatgattagtagtgaattcagcttgctttctaagtgagtaactagcaaagtctttctatttagctagctgctaaatggaaaatgggtgagttttgttaaagtaataatgcaggaagctggggaaagtcctataccggttgttaagagcagatataggctgagtgcaatggctcatgcttgtaatcccaatattttgggaggctcatgcgggaggattgcttgaccccaggagtttgaggctgtagtgagctgtgatggagtcactgcactctagcctgggcaacagagtgagaccctgtctccc

SEQ ID NO: 18955 - DNA, 382 bp, Homo sapiens
aaatactatgaatatgttgaataaatcaatagaatttcaaaatcacatttaagcaagctgaattttatacattaatatgtgcatcctcatagtaaagtacataaagaatcatatttattttcttttttgttacaatgaaacctctcaattgaggcattaattacctgattcagttaatacaggttaaatatattttttacttacacctcttatcttttctactgctttgtttttgtggttggcaactggaagttagcaacttctttgtcaagaaattcaccctcagggggccatcttgggtgatagtcattgataaatatattttattgtatatttatattaggtcaaatttatatatggaaatatgaaattttataaaata

SEQ ID NO: 18956 - DNA, 336 bp, Homo sapiens
ccgggtcacaccgtccagcccagccgcctcggcccacctcaggatcacaccgtccagcccagccgcctcggcccacctgcgggtcacaccgcgaaacacgtctcctaacgggactgttgtgtcacgtcacagcggtggagaacgctgggggaggcaggaagggccgtggaagaaaaaataatccaaggccaggcagacccgaaccgcacgccggagagacacggggagaggagacgcggagccatgttaaaccagaattattcaaccagtgcaatgtgtccaaagagtcgtcttgattaaaaatactacatgagcttttttcttaacaatgacata

SEQ ID NO: 18957 - DNA, 1621 bp, Homo sapiens
cctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtaccaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtacaaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctaggactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcaactggctcaag

SEQ ID NO: 18958 - DNA, 391 bp, Homo sapiens
tgatagttgttgttttagtaggcagtctatctggttgggttcagaccccaagtttcaacctggctgctatggcctataattccaatgaatgtcacttctgtttattatatgctgaattggacagatctacatgttctctacttgggctggggccaggagttcataaaccagtttatgggcttgctctcctgagttcttcatctctgtgatctccctagtactttctggttccctgaggcttcccttttctgttctctcaccagaaacttagaacagttacccctttctgatgtatacttgcatatctaggtccaagcagcaggaaaacagaaaaagacagagtgagaattggtctcatcctcttagaactactgctctaccaaaagagagg

SEQ ID NO: 18959 - DNA, 275 bp, Homo sapiens
ctactcaggaggctgagacaggaggaagaccacttgagcccaggagttctaggctgtagtgtattatgccggtcggttgcctgcactaagttggacattaatatggtgacctcttgggagccagggttaccactaggctgcctaaggagagatgagctggcctagtttggaaatggaacaagttaaaactcctgtgttgatcaatagtgggatagtgcctggaaatagccactgtgctacaagcctgggcaaggtagtgaggccccatctcttaa

SEQ ID NO: 18960 - DNA, 342 bp, Homo sapiens
  misc_feature (101)..(101): n is a, c, g, or t
tgggcgtgggtgatgtgcgcctgtaggccagctacttgggaggctgaagcaggaggttgcagtgagctgagatcacaccactgcactccagcctgggcgancagagcgagactccatttcaaaaaaaaaaaaaaaaaaaaagtattttttgccaagcttcattatttacctattacgtgtgggaaaagaaatgcacctttgaagatggtgtgtatgtgtagatttgggaatattaagctacactttctgggaacttgggaaccagaatattctgcagtgttggagtggaacagctaggaaatgacaagggtggataaacaatgtttggcttctcttaagtaa

SEQ ID NO: 18961 - DNA, 456 bp, Homo sapiens
ccctccctctggggattgaaggctctgggtgtggctggctctctttctcactcagcagggaacccaagtcgccagccgaagagagcccgaggcaggtagctgcagttcccctccaagacttctccacacctgtttgaccaggtacaagatcaggcgccggggtcatctgttcactaggccacggggtcaggacaagagtcacccgcagctctgaggccagatggtaattccaatcgcctccccagttcagcagcgaacccagcaagacgaagataattttcgaaacattcaggctcgggagtagacgtcgcaatggagtgctgtcctcgcggctttggagccacggggcatggccaaggtaaatggaatctgacagctaaacttaggctcaggcctcacgtgcagtgtctgtgagtagaaagggtcacagggccggatttcaaattcaaacactac

SEQ ID NO: 18962 - DNA, 188 bp, Homo sapiens
agagtatcttggttattctcagccccttgtattttcagttctcatatttctaattgaaagcatgtaaatttgtcactcctgcagtttctaattgtcttgctgaaattttcaatttcttatctgcttcaaaatgaaaagcataattattttctagtctgtctaataattccagaatcaaaacccgcctg

SEQ ID NO: 18963 - DNA, 532 bp, Homo sapiens
agccatcatcatcataggagacgacagctctgtgccggttattctagaacaagccatcgtcatcataggagacgacaactctgtgcctgttattctagaacaagccatcgtcatcataggagacgacagctctgtgcctgttattctagaacaagccatcgtcgtcgtaggagacgacagctctgtgccggttattctagaacaagccgtcgtcgtcgtaggagacgacagctctgtgccggttattctagaacaagccgtcgtcgtcgtaggagacgacagctctgtgccggttattctagaacaagccgtcgtcgtcgtaggagacgacagctatgtgccggttattctagaacaagccgtcgtcgtcgtaggagacgacagctctgtgccggttattccacctgaagaccttgcagtgggacaggatgcggacgtggaagacagcgacactgatggtcctgaccctgtgcgggtttaggctaatgtgtgtttgtgtcttagtttttaaccaaaaagtttaaaaagttaa

SEQ ID NO: 18964 - DNA, 499 bp, Homo sapiens
aatctgtacagtactttgaataggggaatttgcacataaaatatatgtaaactcttaatagtatgtgtcatggttaattttatgtgtcaacttgactgagtcagtgggtgtctgcatatttggtcaaacattattctgactgtatctgtgagggtgtttctggggccaagataacatttgaatcagtattctgtggaaagcaggttgtccttccttatgtgagtgggccttagccaattgattacagacctgaacagaacaaaaagctgagtaagaggaactttgcctgcctggtccttgagctggagcattgatcatctcctgccttcagactggaacttacactgtctgctctcctggttctcaagccttcaaactcaatctggaactacactgataggtctcctgagatccagcttgccaacctcagatcctgagacttcttagcctttgtaatcatgtgagcctataataaatctctttttctctataaatatat

SEQ ID NO: 18965 - DNA, 885 bp, Homo sapiens
  misc_feature (731)..(731): n is a, c, g, or t
  misc_feature (733)..(733): n is a, c, g, or t
  misc_feature (737)..(737): n is a, c, g, or t
  misc_feature (741)..(742): n is a, c, g, or t
  misc_feature (749)..(750): n is a, c, g, or t
  misc_feature (752)..(752): n is a, c, g, or t
  misc_feature (758)..(759): n is a, c, g, or t
  misc_feature (761)..(761): n is a, c, g, or t
  misc_feature (763)..(763): n is a, c, g, or t
  misc_feature (786)..(786): n is a, c, g, or t
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggcaagccggggaccttctctcctggggatccangntcangggnncgggcanncnataaannangncaggcgtccggtccaggagaatnggggtcccagtggcccacagtgggaccaggttgtgaggcggaacctacacaagggggggggggacaagccaaagagggcccgcacgtcaaataggaaaa

SEQ ID NO: 18966 - DNA, 857 bp, Homo sapiens
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggtaagacagcccctggttggaccttgttttcgtgactggttccctcttcttcttagaagcaatctgcctgccatttctcacattgcattttgttattctgtccctgttgtttgctctctctttttttttttttgagttggggtctccctctgttgcccaggctggagtgcagtggcacaatctcggctcactgcaagctccacctcctgggttcacgccattctcctgcctcagcctcctgagtagctgggactacaggtgcccgccaccacgcccggctaatttttttgtatttttagtagagacggggtttcaccgtgttagccaggatggtcttgatctcctgacctcgtgatccgcccgcctcagcctcccaaagtgctgggatta

SEQ ID NO: 18967 - DNA, 1350 bp, Homo sapiens
ggcaccgtactggcgggggtctggggagcgcagcagccatggcaagccgtctcctgctcaacaacggcgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaaaactcaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccaaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgggggaaaaaagagcaggtttatgatgcggcgcaattgatctattgccaattgcccttttggggcggatatcattaatggcgggttttaaacgg

SEQ ID NO: 18968 - DNA, 634 bp, Homo sapiens
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggttggtttgcttggggtctagtgagttagatttagggcacttgggaactcgatcctgctctgatactaaagtaatcgagtttttacaaagacgactgggcactagtgtcctggcaagcactagtgtcctgccaagcactagtgtcctgccaa

SEQ ID NO: 18969 - DNA, 967 bp, Homo sapiens
  misc_feature (732)..(732): n is a, c, g, or t
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctggcaagcccgaggacccttctcctggaggatccagntcaaggatcgcagcagcgaacataaaataacggccagtcctgatcggtccccagcaaagaattgggggtgttcccaagttggacacagaaggctggtgaactcagtcttggttgactggcgcaggttgacacttatcgtaaaaaatgaggttgcctgtggggacccacagtactccgaattgactgtgcgccccaagcaaggttgccttccaagaaggttccagggacactgggg

SEQ ID NO: 18970 - DNA, 1402 bp, Homo sapiens
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaaaactcagatccccaagtctgtgacaccagaacgcattgctgagaactttaaggtctttgactttgaactgagcagccaggatatgaccaccttactcagctacaacaggaactggagggtctgtgccttgttgagctgtacctcccaaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgggggaaaaaagagcaggtttatgatgcggcgcaattgatctattgccaattgcccttttggggcggatatcattaatggcgggttttaaacgg

SEQ ID NO: 18971 - DNA, 938 bp, Homo sapiens
  misc_feature (732)..(732): n is a, c, g, or t
ggcaccgtactggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctggcaagcccgaggacccttctcctggaggatccagntcaaggatcgcggcctacccattaaactccaggcccggcctgttccggttcccatgcaaagaacttgtgggggtccccaaactttggaccccaaccccttgtggaaatttaagggtttgcctttacccagccccccatttacccccctcttttttcaaaaaacttggggggggggcctttttagctccccccaaggagcccctcct

SEQ ID NO: 18972 - DNA, 350 bp, Homo sapiens
cgcacagcagtctcacacacacacacgcaaccatctcctgcaacttacggtgctcagttctgaggcaaataaatgaagggctactttttttttggaattgtactttatgagatgttaacgtgtaacctgaagaggcagtactggctgacggcacagcttgtgggtgggcaagttgtattggtgggcacaggagtctgtgggccattggggaagccaaaccctttttgagcttgaccttaggctccaggatggccctcctagaacctccccacaccaaaccccatgaaggtccaggtgaatggacagagggactagtgcggtgtctcctgcacacctgggacactgggcca

SEQ ID NO: 18973 - DNA, 379 bp, Homo sapiens
acttgcatatgtgcttacactggccactgaactgcatacacagtcccaagaggtctccctgcaccgcgaggcccatgctagaaaaggcgttcttcaggaacagactgaggcttcatgaagatccttccctccatcgatcactccattaatcctcccctccattcatccctccactcatcccttcatttactccatccatccttcctcccattttcccatccactccatcagcctctccatccatccctccactcatcccttcatttactccatccatccttcctcccatttccccatccactccatcagcctctccatccatccctccactcatccctcaactcacctcttcatccactccatccatccttccacactt

SEQ ID NO: 18974 - DNA, 311 bp, Homo sapiens
gggatgagaggtggagaagtagagataatcgctatcctcaaatgttgtaaagctgcctaacagagatgcaactcaactagtttttcatattctcaaccaggattgatgaggctacaggaagatagatttcaggtcgatcttcacaataatcctgctctaggcgttgtgtcagatcctggagatatattctacagtgactatattctagtggtcctcaaactttgtgttcgtcacagtcacctgcagggcttgttaaaacgcaggttgttggccccactcccagagtttctgtttcaggaggtctagggtag

SEQ ID NO: 18975 - DNA, 258 bp, Homo sapiens
ctctgtctcaaagatagaactctctctgaatgtattatagtagtgaaccctatttttagtagaggcagcgatgtcatcgtattggcgtttcagaaagttgccttaggctgtgatgtggaaaatggatttggggagagcaaaactaaagtcaggaaactgctaagataatccaattcagtggattcagtaatatttaaatattgcattcaaatattcagtgagtatcttctgtatgccagacacttttctaggccctgg

SEQ ID NO: 18976 - DNA, 451 bp, Homo sapiens
gcccagccatttctaaaatggattaaatcccttgttgtcttgttgtcttttgaagcagttcactgagcacgtgactcatgccaccacctattgatgtcttgggattctggagcatcagtaagttcctgggactaactaagactgtggatgcccgtaaggttgttattgactgcggcgggtgtttgtccctctgttattagatagtcccactctgacttgggtgacctgcttttatatctttcatctggtttttaatttttccacctcctcctctgctgccaggctggcctctgctatcaataagcctgcttcgggcagcttcctctccctttttatggaatggactaagaaatctacatggttggggttgtgcgaaaatcaagagcagtgaggtttaggctggagatctggagacattcgttacagaataaaacatatgaaacagtgcacg

SEQ ID NO: 18977 - DNA, 136 bp, Homo sapiens
tgctgcctggccaggagccaagctgccgcctgtcagtcaccccagagtccaggaccaccaccaccgggaaagagactgttggaggtctggctcagagtcgcagggccacagagagcacagtctaccctgcagtaag

SEQ ID NO: 18978 - DNA, 323 bp, Homo sapiens
cttgtttatggctgaatagtatttcattttgtatatacactgcatttaaaataatccagcagggcgtagtggcttatgcctgtaatcccagcactttggaaggccaaagtgggaggatggcttgaccacaggccttcaagaccagcctaggcaacatagcgagatgccatttctgcaaaaaataaattaatcagacatggtggtgcatgcctgtgttcccagctacttggaaagctgaggtgggaggattgcttgagcttctgtggttgaggctgcagtgagctgtgatcatgtcactgcactccagcctgggtgacagagtg

SEQ ID NO: 18979 - DNA, 262 bp, Homo sapiens
gaggtgatggcaatgctaattagtctgatttgatcattatacaatgtgtgtgtgtatatatgtatatgtgtatgtgtaaatatacaccatactgtgttgcataaatatataaaattactacctgtcagttaaaaatcaaacttttttttaaatggtaacttggacattatggctaggttaaaaaaaagactggaaagaaacaaaactaatcactgcagtatttcaagcaagagatatggattcagagtggtaatactggaga

SEQ ID NO: 18980 - DNA, 218 bp, Homo sapiens
gcaatgtgatgtggcacagtggaaaagcaccaggctgagagcagatctgagtttgggtcagccatgaattttctgtgacttaatagacaacatattccacttccagaggcccttattgcttcttctataagatgagaggattagaccaaatcatttctgtgttttttcccactttcaaactcctatcaccttcctttacctgattcctttacaagatt

SEQ ID NO: 18981 - DNA, 277 bp, Homo sapiens
aaaatgccacggactgcagaacagaactgggcctgaaagcatgtctgggccagctgacggaactgtgcacacgattgatatccacagtgcatatcaacaggcagtctttttggagtttgcaaagcgtgtgccgtgcagtgcccgagcctgcctctgcactcgtgtttccaggttgggtggctctgacagccccttcctgtgggtcctgcgtccttgtgtggagtcacgcttgctcggcagctgctcacttcctccggttgttttgccgctcggctct

SEQ ID NO: 18982 - DNA, 374 bp, Homo sapiens
ctgtaggatggtgctgctaaattgctcccaagctgcctagtgacatattttcaaaaaatatctctctccaactttatcaagtgttctttgtgttctggaaacatgattttgagtcccagctggagctgggacctcataagtcttagatagctgaaattcttctccaactatatccagaggcatatggctagttgggatagacgttaattgcagggattaatatctctgagtctagttgtttattgaagactgaaattaacatttttaagctagataaccaagggttgcacaaaccgtgcatagataaagggctaaaaatgtccattttgatgtctttgacattgggctgaataaatatgtcttggattgtaata

SEQ ID NO: 18983 - DNA, 429 bp, Homo sapiens
agagactgactccacacagctttatctcacctcaaggaaatgctaacatacgccatcagccagcacaccattgacagagaagtgaggagcaagtggttcagcagttcagtaaatatggcggtcaacctgaaacactctgcccacttgaggaagacttgactgtcatctgcaccccgcaagacatatgttctgcacattgccttcctgctccttctgcgaccacagggagaggaagcacggctgctgcaagagctgccaaaaggcagggagcaagagctaattccacaacaagagcaagctcacagtcggtgatctcagtgtcagagtcccactctaccctcttgggatcctatgtatctgagctgctctatgtttaatcatcatcatgtcaccatcaaaaatatttattaaaccgctgcatacataaaa

SEQ ID NO: 18984 - DNA, 398 bp, Homo sapiens
cgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacg

SEQ ID NO: 18985 - DNA, 472 bp, Homo sapiens
agtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctgg

SEQ ID NO: 18986 - DNA, 422 bp, Homo sapiens
tttgttattctttgacattctatatttttattttctttaaaacactaagtcagtagcttcccaaatgttgctctttgagttagaatttttaccatgaagttcatgatgaaatagaaatgttatcaatgtttatacaatttattcacctttaaattatatccatcctttttctgtgttaaaatgccctttttcttatgaagttgtgattctagatagtagatagattttttccttctaatatttggcaaaaaataaaaaaaaaaaaaaaaagttagctggctatggtggtgtgcacctgtagtcccagctacttggtaggctgaggcaggagaatcacttgaacatgggaggcagaggctgcagtgagtcgagatcataccactgcactccagcttgggtgacagtgagtgaaactccatctc

SEQ ID NO: 18987 - DNA, 448 bp, Homo sapiens
ctgctttgaaacacagatttcaacaaatagagattgcccatcaaagatcagacaccttcagaacctgatccaagtgaaggctttgagtgtgagcagtttacttaggaagtgatccaagaatgtggtaggtaggaagggaagtaggacagggtgtagaaggaatacagtaaagggtgaattatttaccataggcaacctaagcttcctctccacggggcactcagggagctagcgtgaagcacacacacctcagaactcctcgctggaggggggttaagggtgttcaagtcagtctttgtctgcagctgttcctagcgtatctggtctgcatgctggcggagcttgctctgagcccagacacagccttaggtgaggaggtgtgggagggcattcagaagttgagctggtgtgccctgaaacagcctagcacaagaaagtcagggtggga

SEQ ID NO: 18988 - DNA, 372 bp, Homo sapiens
accaagaaggagcgcctaagaggcacagaaaaagagagccacagagacagagagatggagaggcagacagacagaggagagccaaggcacaggggaaggggcaggcagaggcaagcacttcctggtgaactgggtcccctgtgtgattggctgctcctagagaacagtttccctggctcagttgctgtgcaactgcttcctgcaattaactgactttattgactttgtctgtttctccccctcctttaacctcttgtttgccaagccatctaaggagccacaccttcgactggaaggggtagtttcaattagcacactgtacatcttgtcaacccacctccacttgaagctgtgataatagatgtaaacaaa

SEQ ID NO: 18989 - DNA, 439 bp, Homo sapiens
aatgtgaagtttaaaaaagtgattatgatggatcacgacgtcaggagatcgagaccatcctggttaacatggtgaaaccccatctctactaaaaatacaaaaaattaatctggcgtagtggtgggtgcctgtagtcccagctacttgggaggctgaggcaggagaatggcatgagcctgggaggcagggcttacagtgagcccagatcacaccactacactccagcctgagcgacagagcgagactctgtctcaaaaaaaaaaaaaaaagtgattatgatgacgcataaatgttcatcaaatcttatatttaactaacaaggaaatatacaatacacatcattcaatatttttctggcttttctttaaatacatagatgtctaacatgatatgttattttagctatttatatgtgttcaatgatattcaaagttggtga

SEQ ID NO: 18990 - DNA, 438 bp, Homo sapiens
ttaaaatgcacacacagtcacagtttaatggcttaatgatgaagcctgaacttttgttggccatcagacgttaacaatgaccacatggacgtctccgattcctgcatagcatttatagggaaaaccagatctttgaacttatgaaaaacccctaacccatcatccaagcacctttcattcctagagattatcagagttttcattacaggttaaattctttgtaactttttcatgtggaaactatcccgttacctcctgttagttctcctgctgagtgcaaatggagtgtatactctacttcctacagctgttttggattttgttacattttccaggttttgggaaaaaaaatgtgctgacagaatgtggcttcatctacaactctcaactgatttaagagtataaacagaaatacgtttcctgattgtatgtaccaat

SEQ ID NO: 18991 - DNA, 402 bp, Homo sapiens
ggggaggatgcccacaggcttcaccagactctcaaagggatcaacgatcccccaaaacatgaacaatcactgctttcaagccagctgggagtcagacctccgagcaacctctaccacctggagaaaccccaagacatagtaagcaaaaaaaaaaaaaaaagaaaatcactgcaagcaaagtgagaaagtaaactctcccttcctcgctcccttgacttttagaaactacgacaaacactttaacctcagcctgttcaatgcctttaagatcagagatagtcatgtttgcctaactttattcaggtcctattacgcaagcctgctacctattcaggaccccaaatgttcatgatctgccgataaggtattcattcacccttcaatttgtaatctaattctcct

SEQ ID NO: 18992 - DNA, 513 bp, Homo sapiens
aatttgatacccattaatccatcgtgggcatcacccatgagagtttttttaatgatttttctaatttttattgttggataggattccacagtttgttgtccatttacttaccacatggatgcatgtgtctttaatttcttccaatggttacttacatctatgtaactacaatgcagaaaacaggaatttggcaaggatacaatgcatgtgtatagttctatttcatcatatgtgtgaatttgtgtaactactgcaatcaacatagaactgtttcatcatcactaatttgttcttcatctctgtaatattgtcacttatatattgttgtagcaatggaataatatagtgtatgacctttggtttttctcactcagcataaagcccttaagatcatccaagcagttatacctatcaatagctcatttcttttttattgctaagtggtattctctagtatggatgactgtaccacaaataaagatgaagtgaacacttcctacaggtttttgtgta

SEQ ID NO: 18993 - DNA, 289 bp, Homo sapiens
agcttgttgcatggatcggtaatttgtctttttactgctcggtagtagtctgttgtatagagctctgatggataggcctggctgagccatcccccatgtcttccaagtcactagatgtgtcagtgaggtcagcttggtccctccagaagagcctgcttgccagctgaataccaccaagtgatctctgcagtgccatgtgggacagagaagtcacccagccaaaccttgcccaatttccccagccacaaaaaaatgagacataaagaagcagtggctgtttttacccact

SEQ ID NO: 18994 - DNA, 165 bp, Homo sapiens
tccctttccttgaggcctctttcccactaaaacccagaggtagcattagatagaaagaccagatatgccctggcaaggatggtaacagagtatattagtcagggtaaactacacaagctgcagtaacaaacatcccccaaacctctgtggtttaacacatgacag

SEQ ID NO: 18995 - DNA, 360 bp, Homo sapiens
gcacttccaggggtacatctgttacctttaatttgcacacataggtccctgttcatgggctgctgtttataaaaaggggtttcattggcatcatttcagccttcagagtgagaaacattgaccctgcttgcttttgttacctaatattctgagctgaataaatgatgtgtacagtatcattgctccgtatgagaaaatgtaaatgactacattacattgttggaaggcagtaatacaaaagggaaatatgaagtcagccgacatttctcattcgggaaaaacaaagctgattctggtgattctgtgtgggagattgtactgggctgcaaagcgttgtcaattgaagatttttttttcccc

SEQ ID NO: 18996 - DNA, 403 bp, Homo sapiens
tctgccaccccttccatggtgatatttctagagtacacccctgtgctgaaattcttatgaggaaagagacctgatgagatgctatggtgaagaggggccataagggtcttgaataccaagttaattttgctaccagctgagattaggaagtgaagcccaggacccaggagaggaggaggaggagataacacaggaccctgtgatcactctcctggccatctgtgtacagtgagacgcttcccttcggggttgggagcacccagtgtcatggtcctgagtgttgctaccctgctgttctcatctgtgaatgcagccagaccactttcttcctctgatataaataacttggaggatctgtcaccagacacctcatatctacatattaataaattctgtacggtgg

SEQ ID NO: 18997 - DNA, 512 bp, Homo sapiens
tggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaatccagtagccacaaaatgaatttaccaatcaaggtctgatttcctagttacctgacactgaagtcagattgcttggatttggatcctgacttgacttatgtgaccttggactagcttct

SEQ ID NO: 18998 - DNA, 1258 bp, Homo sapiens
gagcgcgctgcctgcctgcccagggccttcccggagagcaggtgacggcggcctccgggcatggagctcgcgctgacgaaaggttctggaagccgccgtaaaaagtaatcaagaaacgggtgacaggacttttccctgaccaacatgatgaaaccccatctaaatacaaaacaattagccggactgtggtggtgcacgcctgtaatcgcagctactcagagggctgaggcgggagaattgcttgcatccgggaggtggaggttgcggtgagctgggatcacgccattgcactccagcctaggcgacagaccctttgaggaaccgtttgaggtgtggcacgatacagcaagtcagctgccaaagaggggcttagccacaggaagtgcgtgcccagaacgcatctcccgtgtccctcacagcagttctatgaggctggctgccctgtttgacaactgaggcccgcatcttccccggaatcaccgacgtgtggctctgagccctgtcccagggattttctccatcagagaagaggagcactttgagctttgagaggagcagccctctgcaagtgaagtggaaaaaaaggaagcaggcgaggaggcccatccagaccctcccccaagacccttgctgaaatggctgggatgcggcgtgcagaagctctcctttccttcacagcccctggctttccaagagtccctgcccacccagatgcccgctggcagatgcagcctcatctcaaggacactgcttgctggataaatccctcaccaccctagagacagcccacggtcctgagacaaggatgcgggccaggcttgttgcacgtaagcgcctcccgcagaaaccagtgaggccggagttccagaggaaatgatgtagggacagaggcagagggcctccaggaggcaccagccccagagtcttccctagaatcagactttaagcacaagcagggagggaaagcacttgagcagtgcccgtccctgcatacctggcctctgctggaacccatgcagggacaggacacttctttatcagcaatcctgttcctctcctgggcagcttcaacctgaacatcctccttcaccttgagctaaaatgggtttcttgtcacccttgcccatcaaacctggccttgccctcaggaaccacacaggacaagcctaatacttccttcttgtggcaacactttagcaattgagacctggctgtcaggtcctccaaataaacatttgtgactgtgatgttgaaaaaa

SEQ ID NO: 18999 - DNA, 1053 bp, Homo sapiens
gagcgcgctgcctgcctgcccagggccttcccggagagcaggtgacggcggcctccgggcatggagctcgcgctgacgaaaggttctggaagccgccgtaaaaaccctttgaggaaccgtttgaggtgtggcacgatacagcaagtcagctgccaaagaggggcttagccacaggaagtgcgtgcccagaacgcatctcccgtgtccctcacagcagttctatgaggctggctgccctgtttgacaactgaggcccgcatcttccccggaatcaccgacgtgtggctctgagccctgtcccagggattttctccatcagagaagaggagcactttgagctttgagaggagcagccctctgcaagtgaagtggaaaaaaaggaagcaggcgaggaggcccatccagaccctcccccaagacccttgctgaaatggctgggatgcggcgtgcagaagctctcctttccttcacagcccctggctttccaagagtccctgcccacccagatgcccgctggcagatgcagcctcatctcaaggacactgcttgctggataaatccctcaccaccctagagacagcccacggtcctgagacaaggatgcgggccaggcttgttgcacgtaagcgcctcccgcagaaaccagtgaggccggagttccagaggaaatgatgtagggacagaggcagagggcctccaggaggcaccagccccagagtcttccctagaatcagactttaagcacaagcagggagggaaagcacttgagcagtgcccgtccctgcatacctggcctctgctggaacccatgcagggacaggacacttctttatcagcaatcctgttcctctcctgggcagcttcaacctgaacatcctccttcaccttgagctaaaatgggtttcttgtcacccttgcccatcaaacctggccttgccctcaggaaccacacaggacaagcctaatacttccttcttgtggcaacactttagcaattgagacctggctgtcaggtcctccaaataaacatttgtgactgtgatgttgaaaaaa

SEQ ID NO: 19000 - DNA, 1796 bp, Homo sapiens
gagcgcgctgcctgcctgcccagggccttcccggagagcaggtgacggcggcctccgggcatggagctcgcgctgacgaaaggttctggaagccgccgtaaaaagtaatcaagaaacgggtgacaggacttttcgaacaaggtctcaccatgctgcccaagctggtctgaaaactcttgtcctcaggcagtcctcccacctcggcctcccaaagatctgagattacaggcatgagccaccacacctggccttggttttaattcctgtcacagtatattagttttcgctgttgtgtattgattgattgagacagggtctcgctctgttgcccaggctggagtgcaggggcatgatcccagctcactgcaacctccacctcttggattcaagtgattctcccgtctcagcctcccgagtaacaggaaccacaggtgtgtgccagcacgcctggctaattttttttttttttttcttgaggtggagtttcactgttgttgcccaggttggagtgcagtggcacaatctcagctcactgcaacctctgcctcctgggttcaagtgattctcctgcttcagcctcacgagttgttgggattacaggcgcccgccaccacgcccaggtaatttttgtttagtagagacggggtttcaccatgttggcctggctggtctcgaactcctgacctcaggtgatccacccacctcggcctcccaaagttgtgggattgcaggcgtgagccactgcgcctggcctaatttttcaattttttggtggagatagggtttcaccatgttggccaggctggagttttgcctgttctagaagcttgtatcagtcatacaacacccctttgaggaaccgtttgaggtgtggcacgatacagcaagtcagctgccaaagaggggcttagccacaggaagtgcgtgcccagaacgcatctcccgtgtccctcacagcagttctatgaggctggctgccctgtttgacaactgaggcccgcatcttccccggaatcaccgacgtgtggctctgagccctgtcccagggattttctccatcagagaagaggagcactttgagctttgagaggagcagccctctgcaagtgaagtggaaaaaaaggaagcaggcgaggaggcccatccagaccctcccccaagacccttgctgaaatggctgggatgcggcgtgcagaagctctcctttccttcacagcccctggctttccaagagtccctgcccacccagatgcccgctggcagatgcagcctcatctcaaggacactgcttgctggataaatccctcaccaccctagagacagcccacggtcctgagacaaggatgcgggccaggcttgttgcacgtaagcgcctcccgcagaaaccagtgaggccggagttccagaggaaatgatgtagggacagaggcagagggcctccaggaggcaccagccccagagtcttccctagaatcagactttaagcacaagcagggagggaaagcacttgagcagtgcccgtccctgcatacctggcctctgctggaacccatgcagggacaggacacttctttatcagcaatcctgttcctctcctgggcagcttcaacctgaacatcctccttcaccttgagctaaaatgggtttcttgtcacccttgcccatcaaacctggccttgccctcaggaaccacacaggacaagcctaatacttccttcttgtggcaacactttagcaattgagacctggctgtcaggtcctccaaataaacatttgtgactgtgatgttgaaaaaa

SEQ ID NO: 19001 - DNA, 831 bp, Homo sapiens
cgcagtttgtcagtttgccaacaccctgctttcatgaaaacagtttgctgtttactcatatagcctccagtggtgcactgagttgatcacgaccctcactctttcggcctgcaacactcaagtgatccacctgcctcggctgcccaaagtgttgggattacaggcatgagccaccacgcccggcctgctcctggcttttggctgaaagttgagacttagaagttgggaggagacctggagcaccgtggctagttctaggccctacactcttcagaacagcagagctgtagctgtctggtagtgagctctctgttgctgggagtattcagaggctggatggctggctgttaagggatttctgcttgggtgggaatttgggtccctctaagacagataacctatgatttctgagataaatgggacaatactttcaatgagggttacatgttaacgctgggtcagtcttgagtacaaaatggattcagagacctgagttgtcatgttcaatctgattttcctagccctttgaggaaccgtttgaggtgtggcacgatacagcaagtcagctgccaaagaggggcttagccacaggaagtgcgtgcccagaacggtaaaggggctgtggcctttcttatcatctccactccctgtcccccccatcacctgctcttcgtgctttgtgataattcagtgagctcatactcatgacctgtgtctccagcatctcccgtgtccctcacagcagttctatgaggctggctgccctgtttgacaactgaggcccgcatcttccccggaatcaccgacgtgtggctctgagccctgtcccag

SEQ ID NO: 19002 - DNA, 558 bp, Homo sapiens
gcaaccaaaccaaaacaaccaaactgggtgaggggtgtgacagtactctggctgtgagatccccaaatccccgcatggttctcttccttccaaaaaacaaaacagctccctcccattgtctagcagctggagagtccactggagtgtgttttgtgcttagtgggggtttccctaccatgggggtaagcaggcagaggagaggccagtctctgctccaaaggtacttccaaactcaaacaagacatccaacgcattgggaaacacaacaagaacagaatctggtactcaaatgagtggttcagctttgaagtacaggggctccggggacaaagtggacctgagggggtcctctgaagatgggcaggaagggcagacaaaggcctatagtgggagagaggggccagcctgacaaggtatggataccctacctgcacagtaggatggggcagggagggccctctgagcaggagccagcctgcccctcacccccattcaagtgtgatcacccagaccctggccaggatgcgggggatatgctgagtgatctaggtctcccag

SEQ ID NO: 19003 - DNA, 2808 bp, Homo sapiens
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttactccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgatttttt

SEQ ID NO: 19004 - DNA, 4441 bp, Homo sapiens
  misc_feature (3313)..(3313): n is a, c, g, or t
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcaaacccatgggttgaagccatggagaaggaaatttggatccaatgtaatgaagctctttctaagtcagaatttccctgcaatggtgtggcctgattcaataaaaattaagaataataaatataatggaaaaaaatctccactgattgagtgtttacttggtgccaagcactatgctaagttgttcattattttatttaattgttacagcaattttgagtatgcatctttcactattttataagtggaaaagagaagtgcccccaaaaagttagagctcaaacagcagcttattctaccagcccctgctcttgcggaggcctctggaaaagacctgaatgacacctattggagaatnacatctacaaggggcttcaaacagaccaaatagatcatcacctctgtggtcccttgttaactatatgttctgagacaaaggaaagctaccctaagggttagttaacctttgctgaggaaatttacattcatacttagagtgaattactcaggtgtgcttaggtgtgcaaaagggaaggagacctgaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtcccccaaatcaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatctctgtgtgtgtatatatatgtatgtatgtatctattttcaaactgtgatttaatatttaaatattcctactgccatttttgtgactgaaaaactacacatgaggaaacgtcttagaattttccaatagaggaaaaataacacttgggcaatctgtcatgtttcacaacagttctcatttttctcatgatttgtgtagcgtggaatgtgtttgctcaatgtgaagggttttcattgctcaatttctctgtgtaagtcttttccttaaggtaataaaccatcagcaaagtcacatactggagttggtggcttttcttgtacaggcagttgttatgagacaatgatggagcattgagcatgttcaataaatgtgcagatggtggaaacgag

SEQ ID NO: 19005 - DNA, 4915 bp, Homo sapiens
  misc_feature (3787)..(3787): n is a, c, g, or t
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttactccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcaaacccatgggttgaagccatggagaaggaaatttggatccaatgtaatgaagctctttctaagtcagaatttccctgcaatggtgtggcctgattcaataaaaattaagaataataaatataatggaaaaaaatctccactgattgagtgtttacttggtgccaagcactatgctaagttgttcattattttatttaattgttacagcaattttgagtatgcatctttcactattttataagtggaaaagagaagtgcccccaaaaagttagagctcaaacagcagcttattctaccagcccctgctcttgcggaggcctctggaaaagacctgaatgacacctattggagaatnacatctacaaggggcttcaaacagaccaaatagatcatcacctctgtggtcccttgttaactatatgttctgagacaaaggaaagctaccctaagggttagttaacctttgctgaggaaatttacattcatacttagagtgaattactcaggtgtgcttaggtgtgcaaaagggaaggagacctgaattcaccaagttaaatcttgctaaaccttatcataagcattttttgagcgcttagcatacaccaagccttgtggaaggtgctttcctgccatatctcatttaatcctcacagcaaacctatagaatatggcattatcatctgagtctcacagaagtttagtcgtgtactcaaggtcttaccagctagtgaacagcagaccaagactggaaacccaggatagtctgatacctgagccatctcttcttgtgctacgcctagttattctgtcccccaaatcaaaaggcatgacctttataagaggcgctttactgacaatagctgcaattttaactttgaaaatgattcagaattatcaaagatagtagattcgaatgacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatctctgtgtgtgtatatatatgtatgtatgtatctattttcaaactgtgatttaatatttaaatattcctactgccatttttgtgactgaaaaactacacatgaggaaacgtcttagaattttccaatagaggaaaaataacacttgggcaatctgtcatgtttcacaacagttctcatttttctcatgatttgtgtagcgtggaatgtgtttgctcaatgtgaagggttttcattgctcaatttctctgtgtaagtcttttccttaaggtaataaaccatcagcaaagtcacatactggagttggtggcttttcttgtacaggcagttgttatgagacaatgatggagcattgagcatgttcaataaatgtgcagatggtggaaacgag

SEQ ID NO: 19006 - DNA, 3559 bp, Homo sapiens
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttactccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcaaacccatgggttgaagccatggagaaggaaatttggatccaatgtaatgaagctctttctaagtcagaatttccctgcaatggtgtggcctgattcaataaaaattaagaataataaatataatgga

SEQ ID NO: 19007 - DNA, 734 bp, Homo sapiens
gatgggccacctgttttaaatccaaaagctggtaggagtttcaggtacactgcatttgcttctgctgtcctattgcacttggacttggtgcagctatgacctaatgcagaagacaaagtatgaagctaccaaactgtcagggccagaactaagcctgtataattgataggaaccttctgggtgcatgatgagtggatcttctgataagatacatttaaagtgtcccctgttggtggcttctaatatggggctaaggatgtgaccaagaatggcctgtaatcctgaagcctgccaagattgcatcattgaaacaatgcttcctaccaggtggagagaaaatgcagtattcttatccgagacgtaatagaggccagagtgctgaacaacactatccaccagttccgtagccccatagggctggggaagccactggtatatggaaccttactgtaccctgttgaggcttaaacatgtcagtggccactattcttatagtgtctgatatcatgagtggctgaactagaattgtgccattagtggtacttggcatgcaggcttggatagattaatgctggggtttgttttttgttttgttttgtttttgtttttaaagacaaggtctggctcagttgtctaggctggtctctatctcctggactcaagcgatcctcacaccccagccttctgagtagctagaactacaggcttgtgccaccacatccagctaatgctta

SEQ ID NO: 19008 - DNA, 2446 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcaaaattcatattttattacatttttctaactcacattcttgttcatttgtgtaattgatagatgttttttactcggtcatttaaatgtttaatatttcatctacatatgaattaccacattttgtgtatgactttaattcctactttaaaaaaaatcagcattccagaattgttgtatggcattctgaggatgaaatagaaaacataattcttagccactataggttgaacacctgcaaaatctgattctgtcagcatcttccatgttaagttcctacaaacagtccaacagtcatcagacccattcacacacaatcacattaatagaataacagatgttactttcaaggttcaattcttattaatatgatatagaatctgaataatactgttttgttaataatctgccagaggctgaagaaagttaactgttttggcttcgatacctgaaacttgtgatttgcaggttcaaaagcaatcgtttatatacactgtttcagttgaagttcaaaaagtaccaactatactttatggttggtggaacatttatgcctttttgataaatgataaaaagatcttactcccaactactgcatattaaaaaaagaagttaatgacaagacgattccgtgggaggttgaggcaggagggttgcttgagcccaggagtttgatttggcaagacctggtctctgatttttttaaaaggatgattccaaattaagtctaagaatggaagtgaatgccaagcacagaccctttcacctccacatagagaataaacgtgggacaagctg

SEQ ID NO: 19009 - DNA, 942 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggtaagactgagtacattatcatcttaattataaagtctgtcattctgaacatgtgataaaggtctaaaagccagttttgaaagtaactttctccagtaattggacaggccgtttttgaattctggccaatcatagttgcactttgagctgttagtaataattctttgacactctcattgtctatattacaaaataacagcatttggattgagatttgaagtgactcacaaagtaaccaatgtgctactccctgtccgagcctgataccaaggagagccattggaaagcgtacctgctgattgaagagtgccgcacaaggcaacctcatcagactaggtttgcttctttgggaggtggagagcatataaaccagtggaaaga

SEQ ID NO: 19010 - DNA, 2286 bp, Homo sapiens
tcaatctggaaatacactgcctgcctaaacagaaacacttaggtcaatactatagctttcaaaagggaaggtaacaccgtgtgccctgggtgtggttaatctgtaagaaattttaaaaccacaagctttttcctctacagtatacccttctaccaacataatttgatgtatacttggggatgccaattttttcttaaaacattaactaaaagaaagcctaagtaaggaaacaactttgttggcttttgtgccctccaaacctgaatgtattgcttctgaactgctcagaatgtggtttctgttgtaatgaaggggtactggcttacacattcactgcacacattaagcactgggaaggaaacagtaggcaaagaggtgggtttttcctccttgtcttgtaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcaaaattcatattttattacatttttctaactcacattcttgttcatttgtgtaattgatagatgttttttactcggtcatttaaatgtttaatatttcatctacatatgaattaccacattttgtgtatgactttaattcctactttaaaaaaaatcagcattccagaattgttgtatggcattctgaggatgaaatagaaaacataattcttagccactataggttgaacacctgcaaaatctgattctgtcagcatcttccatgttaagttcctacaaacagtccaacagtcatcagacccattcacacacaatcacattaatagaataacagatgttactttcaaggttcaattcttattaatatgatatagaatctgaataatactgttttgttaataatctgccagaggctgaagaaagttaactgttttggcttcgatacctgaaacttgtgatttgcaggttcaaaagcaatcgtttatatacactgtttcagttgaagttcaaaaagtaccaactatactttatggttggtggaacatttatgcctttttgataaatgataaaaagatcttactcccaactactgcatattaaaaaaagaagttaatgacaagacgattccgtgggaggttgaggcaggagggttgcttgagcccaggagtttgatttggcaagacctggtctctgatttttttaaaaggatgattccaaattaagtctaagaatggaagtgaatgccaagcacagaccctttcacctccacatagagaataaacgtgggacaagctg

SEQ ID NO: 19011 - DNA, 1894 bp, Homo sapiens
cagcagcccattgacagcattagactggcggcatggtgcttttctgagcagatcaatactctgcagactcgaaaaaacatcacgtacattcttggaacttcccagtggtttaatctgtgtgcatggttagggagccaggtctggaataccccagatatttatcattcaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcaaaattcatattttattacatttttctaactcacattcttgttcatttgtgtaattgatagatgttttttactcggtcatttaaatgtttaatatttcatctacatatgaattaccacattttgtgtatgactttaattcctactttaaaaaaaatcagcattccagaattgttgtatggcattctgaggatgaaatagaaaacataattcttagccactataggttgaacacctgcaaaatctgattctgtcagcatcttccatgttaagttcctacaaacagtccaacagtcatcagacccattcacacacaatcacattaatagaataacagatgttactttcaaggttcaattcttattaatatgatatagaatctgaataatactgttttgttaataatctgccagaggctgaagaaagttaactgttttggcttcgatacctgaaacttgtgatttgcaggttcaaaagcaatcgtttatatacactgtttcagttgaagttcaaaaagtaccaactatactttatggttggtggaacatttatgcctttttgataaatgataaaaagatcttactcccaactactgcatattaaaaaaagaagttaatgacaagacgattccgtgggaggttgaggcaggagggttgcttgagcccaggagtttgatttggcaagacctggtctctgatttttttaaaaggatgattccaaattaagtctaagaatggaagtgaatgccaagcacagaccctttcacctccacatagagaataaacgtgggacaagctg

SEQ ID NO: 19012 - DNA, 2179 bp, Homo sapiens
ccgagggcggggccgggcccgggagcctgtggcttcaggaagaggagggcaaggtgtctggctgcgcgtttggctgcaatgagctcggcctcggggctccgcagggggcacccggcagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcaaaattcatattttattacatttttctaactcacattcttgttcatttgtgtaattgatagatgttttttactcggtcatttaaatgtttaatatttcatctacatatgaattaccacattttgtgtatgactttaattcctactttaaaaaaaatcagcattccagaattgttgtatggcattctgaggatgaaatagaaaacataattcttagccactataggttgaacacctgcaaaatctgattctgtcagcatcttccatgttaagttcctacaaacagtccaacagtcatcagacccattcacacacaatcacattaatagaataacagatgttactttcaaggttcaattcttattaatatgatatagaatctgaataatactgttttgttaataatctgccagaggctgaagaaagttaactgttttggcttcgatacctgaaacttgtgatttgcaggttcaaaagcaatcgtttatatacactgtttcagttgaagttcaaaaagtaccaactatactttatggttggtggaacatttatgcctttttgataaatgataaaaagatcttactcccaactactgcatattaaaaaaagaagttaatgacaagacgattccgtgggaggttgaggcaggagggttgcttgagcccaggagtttgatttggcaagacctggtctctgatttttttaaaaggatgattccaaattaagtctaagaatggaagtgaatgccaagcacagaccctttcacctccacatagagaataaacgtgggacaagctg

SEQ ID NO: 19013 - DNA, 2294 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaaaaaaagaaaatgtctttctcttccttttatataaatatcgttagggtgaagcattatggtctaatgattcaaatgttttaaagtttaatgcctagcagagaactgccttaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcaaaattcatattttattacatttttctaactcacattcttgttcatttgtgtaattgatagatgttttttactcggtcatttaaatgtttaatatttcatctacatatgaattaccacattttgtgtatgactttaattcctactttaaaaaaaatcagcattccagaattgttgtatggcattctgaggatgaaatagaaaacataattcttagccactataggttgaacacctgcaaaatctgattctgtcagcatcttccatgttaagttcctacaaacagtccaacagtcatcagacccattcacacacaatcacattaatagaataacagatgttactttcaaggttcaattcttattaatatgatatagaatctgaataatactgttttgttaataatctgccagaggctgaagaaagttaactgttttggcttcgatacctgaaacttgtgatttgcaggttcaaaagcaatcgtttatatacactgtttcagttgaagttcaaaaagtaccaactatactttatggttggtggaacatttatgcctttttgataaatgataaaaagatcttactcccaactactgcatattaaaaaaagaagttaatgacaagacgattccgtgggaggttgaggcaggagggttgcttgagcccaggagtttgatttggcaagacctggtctctgatttttttaaaaggatgattccaaattaagtctaagaatggaagtgaatgccaagcacagaccctttcacctccacatagagaataaacgtgggacaagctg

SEQ ID NO: 19014 - DNA, 369 bp, Homo sapiens
gagcagggaaccaccagattgcctaaggaggggtgaaccggccctggtcgaaaatggagcaggtcaaaattcctgtgctgatcagatctgtttctacgcattttcatatatttgtgcatattaatgttttatattttaacataaatgagatcactcactatatattgttctttgtaagttgcttcccttttaaaatttaatatgccttggctatctggcacctctcaaccttcaagtgtccttaatttataaattttagttagtaaaataacttttaaatacatgcaactataatttatgttgttgtacttctttcattttaatggcaggttaaatcactttagatagcttgagatgtgactcctagtg

SEQ ID NO: 19015 - DNA, 245 bp, Homo sapiens
gtttccttccacgctgttctcatgatagtgaatgagttctcacaagatctgatgagtttaaaactgtttgaaagttcttccttcccacgccctctctcccctgctgccatgtaagatgtgcctgctttcccttctgccatgattgtaagtttcctgaggcctccccaggcatgcagaactgtgggtcaattaaagctctttcctttataaattacccaatctcaggtatttctttattgcactat

SEQ ID NO: 19016 - DNA, 591 bp, Homo sapiens
tcacatgaggaaatgtgtagcttgtagaggtggctgatttaagtaacttgtgcagctctcaaggggtgtctgccttctgtctcctttctaccccatgaaagaagcggggggatgtgaagagaccaggggagtgactccaccttatgcctcaccctggtctcatcttgcccagctgtggtaccctatgttaaccttggctggtcttcacaaaggcgactggaccctgggccctccctgtcccaggatcccctaacccctaccccagaatggtttgtcataatctggaaatttgttggctcatttttctttcaactcctttatttttcattgaacaaatctctgcttttgaagagttgaggttatctgctatctttttttcttttctctccctccctcctgctgcaaagaaaagaaccaataagttttagggatttttgtgtgtatagacattgtcatccggatgtaacttgctttgaagcagtgtttctgttgtgagtgtctcttgctgtaaatatttgttcatatttttgtgaattcagtactgtgtaccattgtattaatagtaactttttataaagcaaaccataaata

SEQ ID NO: 19017 - DNA, 412 bp, Homo sapiens
ggctcctaaatttcctctctcaaaagacatacctcctttgagtaatgtattatatttccataggcctttattcagatgtgttccctgagagggatactctggctccttaggaaggtggatagttacatctgttccatccaattaacatgtactaattgagtacctaccatgtgcaaggcacttttaagacctccagggtgagaatggcatccttcccttcaaggagtttacaacgaaaggaaattaggttgtcaaagtcaagtttgtttcgaagtaggatggccgctaggtctgaaggagcactgcttgggtcattcaacttggaggttaggagtgcagggatgcttgaggcagggacaaaggagaaagagggtcacagaaggggcaatggggaaatgacaataaaccccac

SEQ ID NO: 19018 - DNA, 778 bp, Homo sapiens
aggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtgatggcagct

SEQ ID NO: 19019 - DNA, 325 bp, Homo sapiens
tttcagtgaaacctttttactcactaagatagtttaagaaaatgatatcaccatcatttgaccatggagaaaagtggtacaaaggttagatttgctgaaggtcacacactttgtttctaagactgtgaagactaagcccaggtggctgacttccagctctggcctgcacagcgagaaaataaccacattcagagccatacaatgtcttaaattatttaaaatgtaatgtccttagggaattcttgattgtttccttttcctttgttttcatttttctaaaaagtgcttaaggcagctaaaaaagatagactctaaaaaaaaaaaa

SEQ ID NO: 19020 - DNA, 327 bp, Homo sapiens
actgcatggaaactaggttgagagtttgtgggatgtactcaagtttcctttttagatacatccatggctttactgctttttttcctggactgggactgaaagaactgagtcccagttcagtcactcggtttctttgatgacattgtctttagatcagtgttcttaacctcaactctagttaacacttccctctcatgaggttaaattagatgcttagtttccaaacacatttgcacatttgctaaccctgtccatgttggtttatttcctaccctcataccacattccctagccattcgcaagatccatgtgtgagggatgggattc

SEQ ID NO: 19021 - DNA, 640 bp, Homo sapiens
acagtctggtgtttgcaatagtgtagggtccatcccatctgagttcaaggttagtcttcctgcgatgtcttttccggaggactaaattccctgtttggaaattatgaagaggccgtgatggagtatttggagggaaggcagctcacacttgttagtgacaagcataagtgtacttagtccttgataatatctgagaatgtcgattgtaatagattagagtcctcaagggcccaataggagtagaatccttgtgagtctttgagtgattatttcataagaagattattgatatgtgctctggtaggaagagtaatggcccccccctaagatgtctacatctttatccctggaacctgtgaatatagcaccttttatggaaaaaggaactttttgtgattaagaatcttgagatagggagatttatcttggattatcctggtggacccagtatcatcacaagtttccttataagatggaggcaagaacgttagagtcagagaaatatgtaaatatagaagcagaggccgggccaggcacagtggctcacacctgtaatcccaaagctttgggaggccgagtgggggaggatcgcttgaggccaggactttgagaccagcctgggcaacacgtttctacaaaa

SEQ ID NO: 19022 - DNA, 518 bp, Homo sapiens
ttcctttttagaaaacacctaagtaaaaccattcttgaaaggacacatgaacaaattgaaccagtcagaggggaaagatcaggatgatgaagtgactcagaaatcaggatgtccctcttcatggagagctgcctgaagctgagaagggtgcgacggacctgaaggctgcacagcgccgggtcttacccaaggctcaaggtgaccgctgcctggtttctgctggtgtttattcaaagcccaagggctctccagtcagcaagtggtgaatctagtcagacatgtgtcctacgcttcagggcaatgagcttcccctcagcctaagttcctttgctatctcccctgatggactaccaatagcgcaagtgtctgtgacatgaacataagagggagaatctatttcctacaggaaggaagaaatatcttatatcctgaatactgactcttcttgtatttgttacacattcaggcaattccaagcaaatcccaaatcccattaaagatatgttcacacatgcaaa

SEQ ID NO: 19023 - DNA, 833 bp, Homo sapiens
gggaatagtgtggactctgggaaggatttaaaagggatagtcagaatcagctttttgtaactatgttttctgtgactttagactctacctccttaataaaagccagcctggcccacaggggtaatttcagaagtttaggatgatgaggatttcaaaagtttagaatgatgaatatagtttctacctcatgtagtttcatcagcaatcttcatcttcttaaacttctgaaatttaggatttcagaaagcttagtgctcagaatttacctcaaccaacatgcatctttagtaagtagtattcagagagtattagaaaaatcacaaattggtgctttctgcttggggctacaggaaattgtagtggaaaaggcctatttcctaccaatagaaccaattcatgcatctgtagatcatcttctaggctaatagcagaattcgtgataaataataggcaatttaggttgttttggagcgtttgctctttataataaatatttagggaatggagtaaaatatttatttaaatattaaacactgtgtgattcaaatgtttcaattcctttgctatctcccctgatggactaccaatagcgcaagtgtctgtgacatgaacataagagggagaatgtaagtacaacaccatcagtctggtagaatgactcttttaccccagcactttctggggcagaggtgggagaattacctgagcctagaacttccaggtcagcctcggcaacataccaaggcctggaccctactaaaaaccaaagaaacaaacaaaaaccccccaacccaaaccaaacaaaacatttagcagggcgtgatagtgtgtgt

SEQ ID NO: 19024 - DNA, 457 bp, Homo sapiens
ttcctttttagaaaacacctaagtaaaaccattcttgaaaggacacatgaacaaattgaaccagtcagaggggaaagatcaggatgatgaagtgactcagaaatcagattccattatgacattagtctctggtcacaattatctgaagccttgcaggatgcaccattccacttcatcctgtcttcatcacaagaagaaaatcagtggttcctctgccttgttcctccttccagtggattgcatatccagataatgttgaacttgggagccttcatgctttgatcagtaaaatcttgaatgaatggaagttgacataagctaaaggaatcatcttacaccatgacaaaatggagtaaggctggatccccaaatctccaatgtaacaagcctggaacacttatgtgtagaatgctcagactattagttgagagaaaaataaaattccattttgttcaag

SEQ ID NO: 19025 - DNA, 190 bp, Homo sapiens
agcccagctggacccagccagggcgtctgcagggaaccccagactgaaggctcctggactctggcctcatccctgccaggaaaggggtggaggccagaccacagggttgggcccttctgaagcgggcactcaaaaggaagagacggctgtgcctcgtttgtcaaatgaaatcaattactaacccacaggg

SEQ ID NO: 19026 - DNA, 366 bp, Homo sapiens
attaagaactcttaaaagccaaaaggtaaatgaaagcagaacccacagataggcattgaagtcagcttccattcagacgtcattggccaaaccagtattgagtcatcactggtaagtagcagctcagccagagattacatctccccatcacacatccctcacatctgtatggaacaacaggactaattctcagtcatagaaggtgaatacaaaagattcccaggtcccagaggatggtggagcttcaagaagaaagtagccttggtccctaaattatcacatggagaaaaggggcactcccaccagaaacacctaaattggactattatatgattgagaaataaacttttattatgttaagctact

SEQ ID NO: 19027 - DNA, 211 bp, Homo sapiens
tcaagactctgccaaaaaaaaaaaagaagaagagtaggtggacacagacatgtggatatgtggatggacaaatttcacctttctctccttgccactcctagattgtccttgcaatattgttaaactaataactggaggttcaatatgtcttaaataaaggttcaaactgaaaacttattaactcatgtcttattttttatctaaatcataa

SEQ ID NO: 19028 - DNA, 2892 bp, Homo sapiens
attcctcgagcactgttggcctactggaatcgagtcggccttgttggcctactgggcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaaaa

SEQ ID NO: 19029 - DNA, 2746 bp, Homo sapiens
attcctcgagcactgttggcctactggaatcgagtcggccttgttggcctactgggcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaaaa

SEQ ID NO: 19030 - DNA, 3430 bp, Homo sapiens
attcctcgagcactgttggcctactggaatcgagtcggccttgttggcctactgggcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtgatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaaaa

SEQ ID NO: 19031 - DNA, 1952 bp, Homo sapiens
attcctcgagcactgttggcctactggaatcgagtcggccttgttggcctactgggcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcagtaagttatattttcaggaataaaaagaaagagttgcttcatagtgtgccctataataggttttaaagttaatctttaggaaatacattatttcagtatgtattttctttaaataaacatcattctaaatagtagttcttaaaattttaaaatctgttgaacactatggaccctacccctagaaaaatgtggttatgtccatgtacacaagatcatacatacaattttgggagattcacaaactaaagttgagaagccctgctccacatagtgcttcatgtgtaatcaagattaaaatggtaagataccaggaaaactatttttaaaaaaccttgtttgcattacttttcccatttaaaaataaaatttaggaagtatacattaagaaaaaacattaaaattttttttatctgtgtcctttgttgccatttctactgaggtgtttaccttttacttacttgttatattctaaatcttttgttagagcctaaaaatatcaatagaatgcatatgtatgtgataaagatagtcactctttgtcatatatgttg

SEQ ID NO: 19032 - DNA, 3370 bp, Homo sapiens
attcctcgagcactgttggcctactggaatcgagtcggccttgttggcctactgggcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaaaa

SEQ ID NO: 19033 - DNA, 3516 bp, Homo sapiens
attcctcgagcactgttggcctactggaatcgagtcggccttgttggcctactgggcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaaaa

SEQ ID NO: 19034 - DNA, 1657 bp, Homo sapiens
attcctcgagcactgttggcctactggaatcgagtcggccttgttggcctactgggcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttcc

SEQ ID NO: 19035 - DNA, 463 bp, Homo sapiens
acaactcaaattccccaaattatttgccattaaaacccattagggatataagcagtgagcccaagagttccctacctttggtgtatatgaactcccatggcattccatagctattttttacttcaaagaaaaagagtaagataaatccatacaactgtctcaaaataatgggagttttagcttgacaaaacaaacgtgaaggacttgaggcctgttagtggactgacaggaagttcagtgggcctgatgtaagtcaagggaaatagtaggaattagtaccctaagttgtgggacgtcagatcgcttaggaccttccaagctatgatagaagtttgaatgttatttttatttatttatttttgagacggggtctggctctttcgcccaggaggcggaggttgtggtgagtcgaggttgcgccattgcactccagcctgggcaacaagagcgaaattccatctca

SEQ ID NO: 19036 - DNA, 400 bp, Homo sapiens
tgcaaaatgtgcaggcttcaattgctggttcgttctgtctttgcattcagctcgtactgggggaaccaggcccacagttgggttgcatgggtccctccagtctcctattccatggtcgtacacaccttaagggcacccatagagtttgttcatctcctgcaaaaacacaagcgtaccctcatccccacattagcaaattaattgaaaaaaggcaaaggcttttgaggctgtagctgggggcatgctgttgctgatgcatctgctccacaagctgcaattcagcttcttcctctttggttaaccacgcggtaaaactttccattgataatgagaggcaggctctttctgattaacagaaggcacagagaaaacaaagaaaacaaatcaaagcttatttttc

SEQ ID NO: 19037 - DNA, 836 bp, Homo sapiens
gttgttaaaatcatttcatgaaagaaaaaaaacaacaaaaaacttaaaatcataaaaaatacgggatggatgtaatctcataaaaaagagcagtcttttaagtaaataaatgaaagcaaacctccaagtccctcatgttcccatacttatttttttgatttcatcactgacaggtgagaacttgtctggcctgggagcggctttggagaagtgcttttctaggttgcttctcctgctgataaggaccatgactcacaggaaggctgctctgaaaccccttacaggagaatggggaccatggttgtgttttcttggttacctctcactcggggcatcttcccattagcggttttgacttaattcactctgggcttgaggctcctccttggtaagttggatagttggaaatgatctctgagtcccatgctctggtttcatgggttcctttccttttaagggaaaacaaacttctctgcaatgttaagagaggttgtgatggtaaataaccgaaaattaataagcaatgactgaggagtagccagcccacgatcgctttcctagaatatactctgactcccaaaataagcaggcacagacaacagtgtggagcccctctcatcatatcccgcatgcaaaattcagggagacttggagctaaaaacgcattgacttcttagttgtctccatttgttctgggttaggtgatggatccacagtgacttagcagctttgatgacagccggggcttctggaggcttggcggcatgttaaaaccacctgggtctattccagatggattaaatcaggctctctgggactggggtccagacatcatt

SEQ ID NO: 19038 - DNA, 411 bp, Homo sapiens
atttctttataaaagttttaagtgagtctgtagtcccagatactagggaggctgaggcaagagaattgcttgaacctgggaaatggaggttgtagtgagccgagatggtgccactttctagcctgggcgaaagagtaacaccgaaaaaagttttcggtggagtgagatgctagggagcaacatttgtcacgtaaatcacatgtgtactctgaggcataaggcctagaaaatgacctgaatttcctaagggtagaattcttcaataagtttggagttgagaagcagaggagctgaagggagagatggagaaggcctttttctttttggcttcattctgcttgttaagcattataaaaacaaaccccaagtaaaggaataaatgtaaatgaaataaaacatttaaaatgagac

SEQ ID NO: 19039 - DNA, 350 bp, Homo sapiens
gactaaatttacacagccccctagtatagcctgtggatctatagtatcagcatcgcctgggaacttgttagaaatgccgctagagcttcacttcagatctactgaatgagaatttgcagttttaacaaggtccccaggtgattcttatgcacagtgaagtctggaaaaatactgccctataaggtcctccaaaagaagtgatatggaactcaggagtcaaccaggcaaaggggccagtgaagagtgttccagcatcgcctatatttatgtcatattttcactaccttttcaaaagttttatcttttccctcattcccatgaatatacacttgtactttgtcagaccatgt

SEQ ID NO: 19040 - DNA, 570 bp, Homo sapiens
agttttttttgtagttttatttttttattttttgcgtggggcccttcaggcgtcctggatctatggaacagcacaccacatcacatatcatatcactttcggaaaattcttagctagtatcttctccccattctcttttctgtccttctggaactttaatattaaatctcctcttttttttttttttttagcttgtctgtgatatttcccatttattttgtgtcttcgtactatagtctgtgtaatttcttcagataattctcagtacaccaatactctctgcctgcacctaatctgttgttcagtccatccattgaatgttgttttcatttgttttgtgtgagggcagtgggaggggtgagcgtacaattgtttcttttgaaatctacctagtcagttaacagtctcttcctggtatgtaattctgatttcctaatttcttcctcaaacttctaaatcatttatattctgcaaacactaacgttaacatctgaaatctttgtaaatgtgattcctctgcaggttttcttagctaactcctgcttattggactttgtttcctttttttac

SEQ ID NO: 19041 - DNA, 378 bp, Homo sapiens
agttttttttgtagttttatttttttattttttgcgtggggcccttcaggcgtcctggatctatggaacagcacaccacatcacatatcatatcactttcggaaaattcttagctagtatcttctccccattctcttttctgtccttctggaactttaatattaaatctcctcttttttttttttttttagcttgtctgtgatatttcccatttattttgtgtcttcgtactatagtctgtgtaatttcttcagataattctcaatcatttatattctgcaaacactaacgttaacatctgaaatctttgtaaatgtgattcctctgcaggttttcttagctaactcctgcttattggactttgtttcctttttttac

SEQ ID NO: 19042 - DNA, 426 bp, Homo sapiens
ttctgtaactttagtgtgtgtacttccctctccaccccagatatagttggaagagaatgaccttcttagatggtcacttctatgcttttaaagggtatgcatgaagctggaagtctccaactgaactgtttttaaaaacaaagatgccagctgggcactattgctctcacctgtaaatcccaacactttgggaggccgaggaagaaggatcacttgaggccaggagttcgaaaccagcctggtcaacagagcaagaccctatttgtacacccaaacaaaaattagccaggtgtagttgtgtgcacctgtagtcctagctactggggaggcagcggtgggaggatctcttggcaggagttcaaggtttcaatgaaccatgattgcaccaccgccctccagcctgggtaacagcaagactttgtctct

SEQ ID NO: 19043 - DNA, 307 bp, Homo sapiens
ttccaaaagtgtttatagctaatataaaatggatataacaaaaatatttccctcttttgccttaactaaagaatattttatttggttgtgagatatttttacagtgctcttagaggccctggataattatataaaactccaaattacacaaactgtacacttagattataaattatgttcatattgtgaattttctaagcaaataatgggaaacttaaaaaattaatcaccatattcctgagaccttgattttatttttaatgtaaaggatatcctgctcacacttttatattcttttatatatata

SEQ ID NO: 19044 - DNA, 434 bp, Homo sapiens
gtaccctgagcccagtccctacctgccttctggaagatgttggctccagaattctctgcctccctcctgcaggcattgtggcattcacagctgatttgcagagagcccagatgcatctcataaataaggaatgtactgttctgcaggacggctgtggcgtggctgtgtgggggtgggcaggctggagtagacaggaaccacgagaggcagggaggactgtacaggggttgctgaccaggtggaagatgatgggagcctcagaaggtgtcgtgggacagggtcagggagagggctctatgcggccaggatctggatgcagattgttgagactgaaatttggctcagatcccttctagttgtgtctgtttatcttcagtttccttgtctataaaatggggagagattgtgtgtccccggcatcactggactgttaa

SEQ ID NO: 19045 - DNA, 281 bp, Homo sapiens
gactggagtctagagagccaaggagttcaacacaggtcaagcactggatgaatgctgggtagcagtggccagaactgaggcaggggagatgggcctggacacagaggagggcatgtgacaagtcttacacatggcgtgggtggaggtagttacccagaaggtaataggaaccagggaaagctttgaagtaggagaatgtgtgagaatgtatgatttagatcatgtggattaacgtcgctcaaaattaaagaaataatttgcagctttggtatgtgatattt

SEQ ID NO: 19046 - DNA, 285 bp, Homo sapiens
gtggatttctaatggtaatttcctctttccctgtttcttataagggagatttgcccatttaatcccattttaaaatttattcaatcatttgtgtatgttattataaactcacaaatatttattttattatttgggctataatccaatgctgtatatagagagggagacagggtcttgctccattgcctaggctggagtgcagtggtacagtcatggcttgctgcatccctaaccttctgggctcaagcgatcctctcaagtagctggtgtcatctgccttgctaa

SEQ ID NO: 19047 - DNA, 344 bp, Homo sapiens
ctagtcagaaagaactgctacaaaataagattgaattatgagttgcagctctgatcctaacagacaaacaaaataaggctgaaaatacgtactagaaagaatttgaattccttccgtggtggactagggcaaagatggtgtgaatgccagtaacccaggctcacgtcaggatggggtgacagaagtcagctggatgggatcaaattgttacccagaaggtctggaaaccaacgaggtccctggtgtagtgaaggagaatgggctggcatcagatgtcagaagtgggaaccagaggctggaactgaggtaaccataagcagtcttggtaggtaaataagtagaga

SEQ ID NO: 19048 - DNA, 376 bp, Homo sapiens
ggtttctaaggcctattatggccgagtccccagagacaaagtttcctcctgtctgacttggagcagatgctcgtctgcctcaggaaaggctctgaagaatccaggagaacatgctttgcaaggcactttcaaattgctgggtcccttcaggggaaaaggggtttttatgacaccactagtctgaagataatttttatcagatcctatagcctgaggtcttaaaacagaacaacactaaagagcccctctcaggcctggcttcctagcagcagttggatgggaccttgaagtggtggctcccttcatgttggccctgcagggtcaggcatctaagactcgtggaggcccaggcagtctggagggataccagatgaca

SEQ ID NO: 19049 - DNA, 381 bp, Homo sapiens
ccatgggctaacttgacaagcccactggatttgactttagcttcttgctctagccagaggttaccaacacctaaacacaaaatagactatctgctcctgactgctgcagaactaaagagctgactttattcttgagttctttattcagagtcccagaaaattatttctaaaatgcatgctgggataactttcaaaatcaggatttggtttactttgcaacagatattaccacacaaaaaatattaaattttagaaaacaagacaaatcatctttaacttaatgccctagtcttccttaacaaaagcaaagacaacaaaatttaagaagctgtaccctaacagaatcttggtaaggggaaccttattaaaaggatatgccag

SEQ ID NO: 19050 - DNA, 410 bp, Homo sapiens
ttttaggttttgtagatcacactatctgttggaactacaattctgccattgttgcacaaaagcagccatagacaatagataaatgaataactgtggctgtatcccaataaaactttattcacagaaacaggtggcaggtcagatctggcctgcaggctgtagtttgccaacctttggttgtacctttagcaccgtctactttcaagtgatattgtactatttcactaatagtattagtaccttatcacagcacacttccattctcctctaccagcctttgtgctaatgttttcacacattttacttttatacaaaatgtaaaccttaaaatacattgttattgtttttcttttaatagttgtattttcaggagatttaaataataaatgaagtcatttgaattatctaca

SEQ ID NO: 19051 - DNA, 1649 bp, Homo sapiens
tgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaacattttggtcctctcagcgttctctgtgttgtgctgttgccccattaccaaatggttagattcaaaaagggtgggaaaagatttttaatatcccaacaaaacattatagaaactctggcttttgcagtgtgcatagactacatgtagttttatgaaaataaatacacatttttatttcagcaactttgaaaagttacactcagttgagttactagaactcatcttgtacaacagcaatgtttagtctgtttaatttaatgtcaaataaaaggtcagatagccctcgtgagtgaattacatagctgtcggcagtcacatcagcaaatgcaccaggcttagaacaaatgtttgttacttgctgcaaaccaagctaatgtgtatagccagttagaaaaagtccagaagtaatgagattctagaagtagagtttcccttgcttggaaacatgaatgtgttcacctgtgttttgtcagagaagtggcaataagtcctggacagctgacactttttaagtatctcccctatttgctactacttttgtgcctcaagtgcccagtcgttacggtggccttctaaatgagtaaataacattttccaatataaagcctatttgcttaaaagggacaggggagtggatggatgtagtacatgcaatggaaaatcataaaatgtacaattcttctgttt

SEQ ID NO: 19052 - DNA, 168 bp, Homo sapiens
aatcttccctgatgagaacgtgtccttattcagctcagagttggtatccctcacacttgttctctgatagactttctaatttattcaggatatatgaatgctgtcatattctcctatatataggttgtgaagaagaggatcttggatagacattttgacttcatacat

SEQ ID NO: 19053 - DNA, 1205 bp, Homo sapiens
gtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctgggagccataaaactgcctattgggaggctaaatgctctgcttttctataaaacagagataaggttctagaggaagtactgttaccagaaacaaggcacgtttcttctctgcctaggaatgcttcatctgggggacagaggggaaggtttcaatggaaaaggaacttatattaacaagtccctactacatgatgcaacccatttcaaatgactcctctcattttgatcttcaggaataactgatctctgggcattgatttcacagatgaagtctactattgttttggtagtatttaaaattgggatctcaagtttcaaattgatcatcattgggcttttcatgtgtatagaacaccttcactctgcataatcctacataacaacattcttgtcttctagtacatgaaaaaattggggtaacatagcatttaaagtagttatcagggaaaagtctatactgaagtgaaccctacactgttattcaagttgccttaacacattataagctattattctaaatagctttaacagattattgtggtcacactgtattactaatagttaatttaaaaggcagactcagcatgttttaaactcctttaagttacatcttcagaaagtcctgaagtccttcagtattaggtcagctaagggaagatatatttttaaaaatagtgataagactatcactaatatcatactcatcctgtaatatgtaaacacagttctgttgttactggcagaaaaattggaatacccagcattaagtgagagaagtcagcctacttttatgatgaagctactgggatttatttgaactattatttttgttagatagtataaaaatgttctaagtgcctatttttctcattccccttttaaaaatgtaatgctaaaatttctagaagtgttgtaaacacggaatacaaaaaaactatgattgatta

SEQ ID NO: 19054 - DNA, 1522 bp, Homo sapiens
gtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctgggagccataaaactgcctattgggaggctaaatgctctgcttttctataaaacagagataaggttctagaggaagtactgttaccagaaacaaggcacgtttcttctctgcctaggaatgcttcatctgggggacagaggggaaggtttcaatggaaaaggaacttatattaacaagtccctactacatgatgcaacccatttcaaatgactcctctcattttgatcttcaggaataactgatctctgggcattgatttcacagatgaagtctactattgttttggtagtatttaaaattgggatctcaagtttcaaattgatcatcattgggcttttcatgtgtatagaacaccttcactctgcataatcctacataacaacattcttgtcttctagtacatgaaaaaattggggtaacatagcatttaaagtagttatcagggaaaagtctatactgaagtgaaccctacactgttattcaagttgccttaacacattataagctattattctaaatagctttaacagattattgtggtcacactgtattactaatagttaatttaaaaggcagactcagcatgttttaaactcctttaagttacatcttcagaaagtcctgaagtccttcagtattaggtcagctaagggaagatatatttttaaaaatagtgataagactatcactaatatcatactcatcctgtaatatgtaaacacagttctgttgttactggcagaaaaattggaatacccagcattaagtgagagaagtcagcctacttttatgatgaagctactgggatttatttgaactattatttttgttagatagtataaaaatgttctaagtgcctatttttctcattccccttttaaaaatgtaatgctaaaatttctagaagtgttgtaaacacggaatacaaaaaaactatgattgattactcaaactctccttccttcttagtaaggaaaattaaaattccctttggctttctaatttacttgttctactaggtacactaacaaaactacttctggctgggcgcggtggctcacgcctgtatcccagcactttgggaggccgaggcgggaggatcacaaggtcaggagatctagaccatcctggctaacacggtgaaagcccgtctatactaaaaatacaaaaaattagccgggcgtggtggcgggtgcctgtagtcccagctacttggaaggctgaggcagaagaatggtgtgaacccaggaggcggagcttgca

SEQ ID NO: 19055 - DNA, 954 bp, Homo sapiens
gcaggatgagcagcgctcaaaacctcccactactgctgctgtctgtccggtcctagacaagttgtctgcatttgttagatgtggacgaatagtagtaccaacttctaatgttgcagtggggattggaccacagccccagaccagccctacaggagtttgctccaagcgccactggcctggcccagcacacaggttgcctcgtccgccgcctccccacagcacctttcctgaattctgtcagcattgagacccatctcctctttctctgtctctctttgcctgaccctcgtccattctcctagtgggcaggatgctgtcagctattgctatttggagggtgagatgacccctgagtagaaataactcctataagttcagaggttcagcctttaacaaactcacattcctgtttgactgacagatctcccagaaaggaaaataaaagcaccttgaggacagagctggaagtagtctacctgggtattctccacagctgcaagctcaatgtcctgagcttgctggtactcagaaaatgtttaggaacttctttttacattgagggtagtgcttatgggcaaaatgaatgcccatgggcctagccctgagatggctggacagcaagaaaggagaaaggacagcatgggcaattttccacacatgttttaagtttacagggggaaagagaccaagagaataagatcaagtcaaatcaaacccatgtataataataccattaccaattgttttcttattttatgttttattctgattccttctaacaaaagttcacacacacatacacacacacacacacacacacacacgttcagcagagctcaggttgaaaataagtgccagtccttataccaaaaagtagtatgctgtgctttgaaattcctgaaagctcatttgctgcctcaccctccctctccccatgtcctatagaccctgtgt

SEQ ID NO: 19056 - DNA, 725 bp, Homo sapiens
gcaggatgagcagcgctcaaaacctcccactactgctgctgtctgtccggtcctagacaagttgtctgcatttgttagatgtggacgaatagtagtaccaacttctaatgttgcagtggggattggaccacagccccagaccagccctacaggagtttgctccaagcgccactggcctggcccagcacacagatctcccagaaaggaaaataaaagcaccttgaggacagagctggaagtagtctacctgggtattctccacagctgcaagctcaatgtcctgagcttgctggtactcagaaaatgtttaggaacttctttttacattgagggtagtgcttatgggcaaaatgaatgcccatgggcctagccctgagatggctggacagcaagaaaggagaaaggacagcatgggcaattttccacacatgttttaagtttacagggggaaagagaccaagagaataagatcaagtcaaatcaaacccatgtataataataccattaccaattgttttcttattttatgttttattctgattccttctaacaaaagttcacacacacatacacacacacacacacacacacacacgttcagcagagctcaggttgaaaataagtgccagtccttataccaaaaagtagtatgctgtgctttgaaattcctgaaagctcatttgctgcctcaccctccctctccccatgtcctatagaccctgtgt

SEQ ID NO: 19057 - DNA, 419 bp, Homo sapiens
actggatgaagtgttaccttggctacggaacagagctaccctttctaaacagagggacattttgggtaccttgaatgactgactcttagaaagatcacgggcacaggagatgcctcagcaaagctgagatcagagctttggagccaccctgcgacatctttgggcctctgccttgtctccttgaaagcatgcctcgtagccagcttcaaagtcagactccccatgcctggtgttcagtaacagcgggcttctcattcaaaaattttgcagaggtaatagactgtgactttcttttgtgacaacggtgcctcagcacaatcagacaacttgaatatgtttaaaataaccttgcagaaatcctcagaaaaagtaggcaagatagacatcaattgccaaaacagtcccagctagggatccac

SEQ ID NO: 19058 - DNA, 500 bp, Homo sapiens
  misc_feature (274)..(274): n is a, c, g, or t
cctggaccctctctccttatcccgagcactaacaatatgggttccactaccaataccgtaccctctaatcaacataaatctaggagtactattcatgcgacccatgtcaagcctagcagtctattctatcctatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttnccaaagccaggatcgcaaatcagccagcagagaggctccaggcgcctggaccctctctgcacgagagaggtgaggaaggaggggccttgagagaggccgcagagtagagccccaagctgcaaaggccaacagcatggggagaaggaccccgcttttggacccggcctgcacctgagtgtgacgggttacaagcagaggcacccagagagggtacagcggggatctc

SEQ ID NO: 19059 - DNA, 2062 bp, Homo sapiens
  misc_feature (1620)..(1620): n is a, c, g, or t
  misc_feature (1630)..(1631): n is a, c, g, or t
  misc_feature (1634)..(1634): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgnacgcagtganngcngaacacgcatgcaggcgcaggggagcgcgaggagcgtgagcgggtgggagataggccggagagagggtgggctacagaggcaagggtggaacgagagccctagagcgggacaggtggacgcgaaagaatgactggaggacaagcaggggcaagagagaggatcactgcggagggaagggagtagtggctccgaaatgtatataatagaaaaggggcgcgaggaggggggacgaaactgatggggagagtaatgtgtggaaaaaaagacagattaggaaattgatatagcaaacgaacaataaaatgagggcagaattagaggaaagacggagtagagattaatagtgtgtgatgatatgcgaatatgattatgttattgttagtatgtttgttatgctaatgagaatagtgaagaagaaggtggaggt

SEQ ID NO: 19060 - DNA, 1729 bp, Homo sapiens
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggac

SEQ ID NO: 19061 - DNA, 1686 bp, Homo sapiens
  misc_feature (1620)..(1620): n is a, c, g, or t
  misc_feature (1630)..(1631): n is a, c, g, or t
  misc_feature (1634)..(1634): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgnacgcagtganngcngaacatacgccacccaggcgcagtggagcgcgatgaacgagacccgtcgaag

SEQ ID NO: 19062 - DNA, 3007 bp, Homo sapiens
  misc_feature (2565)..(2565): n is a, c, g, or t
  misc_feature (2575)..(2576): n is a, c, g, or t
  misc_feature (2579)..(2579): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccaggtactgttaaatgaaaaacttaccagcgggggtttggaaccattctagttttccaccttctctaatttgaattctttgatttttaaaagttaccttactatagtatacattgttctaaaggtttacaatccaaaacctaccaggatcatagagattggaaacccagccatatcaccagatctgtgaaagtggctcacttctcattttacaaaatgtattggtgagatgaaagtatctcatgcctttttgaatatcaacagcattgaatcatacatagagaaagagttccagatgcctctcttgagagctaatacctctgcacccacaaaacagatcttgtgatattgggcagtagcttaattttgttgtttttaattgaggcagctcaggtagtggtagggagatacattttaaaacataaatttgagacataactggattccagaagaggaaagagtgtcttcatgagaattccaaacactgttcactttctggactgcaaatatctcagagcacggatggaagagattctggttttcatgttggactgttctgttaaaagaaattcaaagaaatttggaaattgagctgttcagtgaatggtgatacattcagttaagcaacttggactttggaagctaaatttggaagagtcatatctaaacgacgacagaatgaagactgtcaagaatcagccagaaggttttgggggttaaatctctgggatgcttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgnacgcagtganngcngaacacgcatgcaggcgcaggggagcgcgaggagcgtgagcgggtgggagataggccggagagagggtgggctacagaggcaagggtggaacgagagccctagagcgggacaggtggacgcgaaagaatgactggaggacaagcaggggcaagagagaggatcactgcggagggaagggagtagtggctccgaaatgtatataatagaaaaggggcgcgaggaggggggacgaaactgatggggagagtaatgtgtggaaaaaaagacagattaggaaattgatatagcaaacgaacaataaaatgagggcagaattagaggaaagacggagtagagattaatagtgtgtgatgatatgcgaatatgattatgttattgttagtatgtttgttatgctaatgagaatagtgaagaagaaggtggaggt

SEQ ID NO: 19063 - DNA, 1343 bp, Homo sapiens
  misc_feature (1259)..(1260): n is a, c, g, or t
  misc_feature (1289)..(1289): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaaagacacagacagtgaagaagaaattagagaagcattccgtgtgtttgataaggatggnnatggctatattagtgctgcagaacttcgncatgtgatgacaaagcttggagagaagttacagatgaagaagttgatgaatgat

SEQ ID NO: 19064 - DNA, 3433 bp, Homo sapiens
  misc_feature (2991)..(2991): n is a, c, g, or t
  misc_feature (3001)..(3002): n is a, c, g, or t
  misc_feature (3005)..(3005): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccaggtactgttaaatgaaaaacttaccagcgggggtttggaaccattctagttttccaccttctctaatttgaattctttgatttttaaaagttaccttactatagtatacattgttctaaaggtttacaatccaaaacctaccaggatcatagagattggaaacccagccatatcaccagatctgtgaaagtggctcacttctcattttacaaaatgtattggtgagatgaaagtatctcatgcctttttgaatatcaacagcattgaatcatacatagagaaagagttccagatgcctctcttgagagctaatacctctgcacccacaaaacagatcttgtgatattgggcagtagcttaattttgttgtttttaattgaggcagctcaggtagtggtagggagatacattttaaaacataaatttgagacataactggattccagaagaggaaagagtgtcttcatgagaattccaaacactgttcactttctggactgcaaatatctcagagcacggatggaagagattctggttttcatgttggactgttctgttaaaagaaattcaaagaaatttggaaattgagctgttcagtgaatggtgatacattcagttaagcaacttggactttggaagctaaatttggaagagtcatatctaaacgacgacagaatgaagactgtcaagaatcagccagaaggttttgggggttaaatctctgggatgcttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatggttgtgttcttaaattcttcctaattacctttagcccagcagaattaattaactcctgtgggtctgaaatcttatggttaggtcagattttcaatacaagtttgtcggggtatcattttttcagaactaaatttcgggtaggtatgcaacctcagcacgaattttatggttttgagtttgtttcctccatgctgcttccttgtggagtgacattgtcttttgtctctagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgnacgcagtganngcngaacacgcatgcaggcgcaggggagcgcgaggagcgtgagcgggtgggagataggccggagagagggtgggctacagaggcaagggtggaacgagagccctagagcgggacaggtggacgcgaaagaatgactggaggacaagcaggggcaagagagaggatcactgcggagggaagggagtagtggctccgaaatgtatataatagaaaaggggcgcgaggaggggggacgaaactgatggggagagtaatgtgtggaaaaaaagacagattaggaaattgatatagcaaacgaacaataaaatgagggcagaattagaggaaagacggagtagagattaatagtgtgtgatgatatgcgaatatgattatgttattgttagtatgtttgttatgctaatgagaatagtgaagaagaaggtggaggt

SEQ ID NO: 19065 - DNA, 1263 bp, Homo sapiens
  misc_feature (821)..(821): n is a, c, g, or t
  misc_feature (831)..(832): n is a, c, g, or t
  misc_feature (835)..(835): n is a, c, g, or t
ggtatacagaggcgtgacagtgccattcatctgcataaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgnacgcagtganngcngaacacgcatgcaggcgcaggggagcgcgaggagcgtgagcgggtgggagataggccggagagagggtgggctacagaggcaagggtggaacgagagccctagagcgggacaggtggacgcgaaagaatgactggaggacaagcaggggcaagagagaggatcactgcggagggaagggagtagtggctccgaaatgtatataatagaaaaggggcgcgaggaggggggacgaaactgatggggagagtaatgtgtggaaaaaaagacagattaggaaattgatatagcaaacgaacaataaaatgagggcagaattagaggaaagacggagtagagattaatagtgtgtgatgatatgcgaatatgattatgttattgttagtatgtttgttatgctaatgagaatagtgaagaagaaggtggaggt

SEQ ID NO: 19066 - DNA, 938 bp, Homo sapiens
  misc_feature (481)..(481): n is a, c, g, or t
  misc_feature (671)..(671): n is a, c, g, or t
  misc_feature (726)..(726): n is a, c, g, or t
gtaaatgattctgtcttcagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagtgaagtcagatgatgaagtatctaaattgtttatagtttcatagatttattaagtgatttggaaaacatcttgtcaagtaatctgcctgcccagacattggatcatcgtagtctttgtctgacacaaatcctggacctgacacccagtcccatctggcccagcccagaaccccggaatcgatttngatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaatctaacttcttaggccttgagatgtngacacacagacacagacagacttaaactttttcttagacagtagccctcatctgnctctgcgaagtatcctgaaacactccagactttcccgtgagtactgattcaactgacacagagacccaaaacgtgaaggagtctccatgtacagaattatagctgtactagaagcaaagtcagttgacgcagtaagaacgacagacaatgaggtctggattgaaacctggggagcttgtcttcaccagcaagcacaactccggacgatgatg

SEQ ID NO: 19067 - DNA, 324 bp, Homo sapiens
tgaggtgtctcagatgtttataaagtgaccacttgtgtagtgctcagggcattgttgcttctgtaaagtgcgtatcatttgatctcatgctgtaaatgattctgtcttcagggcgcaaaccagaagaagagggtgtggaagataacgggctggaggaaaactctggggatggacaggtatgtgcagccttgcgagtgagtagcgtggtggatggaccagtggcggtcacatgatggttcggtctggttgtgtcacaggaggatgttgagaccagtctggagaacttgcaggacatcgacatcatggatatcagtgtgttggatg

SEQ ID NO: 19068 - DNA, 507 bp, Homo sapiens
gttgctatttgaattaaaacaacaagtctccttggtttaattctgtgctcacaggtaacgttttgatccataagaagagatgatgcatatcttgcagaagcgtatattctagttctcaggacaatgatatttttcattataaattaataacttgctcttttgattcagaacaagtctctagaacttaaggaagcttttcctcagaggggctccacttgcactggctcactgagccggcagcagcccttgaaagaacccccctgggcagtagggtgtatccttcccaacagcaccttgaccaggagagtcttctcgaaatgcccgtaccctgtggccctgcctaatggtgtctgtagcattaatacaaatcttaccttgtaaattccttgccttgacaaagtgtcccagttaggtgcgactctttccatttcctaagaagaatgaagctcagatcacttgttgttaatgagcttcagcagtctgcaatgtgaaatgtttggatctgct

SEQ ID NO: 19069 - DNA, 2177 bp, Homo sapiens
ggaagctggctggctgcctgttaagatgtatcttaggacaaagagatttgggatcctggagagcacgggggagattctgctgcctgccttaggacctttatgaacaagcgtgatgttgggagggcggctgtggctgtgtaccaggtgctgtaggaggcgctggaactggagccttgcatccgaatgacaaagtgcctgccttcccggagcttacattgagtgcggaggacagaccagggactagccagcagacagtcccatgtgtcagggtctggtgtttgcagagggtgtttgcaggggtagagcatgacaggaagtggctgttttggataagacgatcaggaaaggtacccgtctgcggaagtgatactgggtctggagtgaagcggttggaagaaaactgcacctctctggaggaagacagtgccaggcacagctgaaaatccggggctagagctactgggaggaacaggaggagcagctgggaaactgggtggccggagcagacggggagggtgagcagggagggtaaagataagcaagcaaggggctggggctgtcaccgaggtggggtgcctcggagggtgcaggagcagagtcaggatctgacttaggtttgataggctcctctggctgtcctgcgatttatcagggacccaggttgcgagcaggccgaccactcaagaggcgtctacatcaatgcagtcaaaggctatgctgacttggaccagatggatggcggaagagccatgacagtggtccggggagagaccacaagtttgcaggcagggtgctagtgaaaaagaggcgtctactgaaagctgtccaggagaaatcagactaggttagccatgaatattttctctaattctgtcttctatttttctcctccagttatatgtaagggtcttactgcaaattgtcagtctatcgttctctgagccaaagtggaaaccaataaaagtgttgggagctgcctacattctagaactgaccgtacagggaaagaggccacacttttccacgcatatttcctggagtcctggaatggcttcttcacatatttctccacccccattagacaactcagtcactaggcaagaggatggatcttggagtctgacagacaggcatgggttcaatttctctccaacgattatttcatctcggtgcgacctcaggcatctttgctttcccagactttgttttctcattagcaaaacagacctaataaaaggactcatttcataggttttttatgaggattaattgagataaaccagataatacgcttaacaccgtggtacttgcaatgaagaaaatggtgaatggtacatacatggtaagtggtcaatacattttagtcattctattaacaagttaataatcctctccatgccttgatttccttattggtagaatggggataataaaacccccttctgggtagttgggagaagtcaagcattaataccagtgaagcacttcaaatggtgctttgcatacagcgagtgctcaataaatgttaaattcttaaaatcatcaccacgattctgaccttatggactttgaagggcagatgttgtgtctcattgctttcgtgtccacaagacctggcacatagacgatgctcaataaatattatttgaaggagtgaatgatggtgacatggttcttaggagttaaaatgagaaaacccaaggagccgaaagcatgtctctacggggaaaggttagagagcactgactcaaaccatcgtctccaattatgcagttttaatgaggaagcaagcccaaccttgaacattatttaagccagagttatcccaataagcattttcctaccatgagtggtagattaagtagcattgagtcatgtagtgaaagtaatgtcccttcttcataccatttcaatgcctctggtaagtcaagagaaagtctttgataatagcctatttttaacacctctcacccttgtttgtcagaaagagcagacctcagattcagagactttagcaagcaaagatatccagtaaagaaatgaaataatggccgggcacagtggctcacgcctgtaatcccagcactttgggagtcctaggcaggcggatcacgaggttgggagttcgagaccagcctgaccaacatggcgaaaccccgtctctactaaaaatacag

SEQ ID NO: 19070 - DNA, 340 bp, Homo sapiens
cccctgctttctgacggcatccaattagagtgaaatcctaactcctcagacccttccccatatccccaaagcccaaaccctacaaaagcttttcttgcaccctcctaccgggacaccccatagttcctcagggtgtgtgtgctctctggctgccatgagtaataaacctaatttgtttaacttacagggttgctcctggtggtctttggccaaagggcactgaccaagtaaatgctaagaaaaaaaaaagttatgtccctacttccaagtacactataaatactgtatgaatcctagcttgtgagggttgtattaggtatagaagacttcttgaaagacg

SEQ ID NO: 19071 - DNA, 383 bp, Homo sapiens
ggccactgagtttgggtggtgtctccggtaccagcaaggcaatggaaggcacactgcccatgcttgacatttaatgaacccttttcactctctatttgctgaaccaactctctaaagtttaggttgttaatctccagaagtggtggaattaaacacaagcacacacacacatacacacaaacaaaaactcacctgtagtcttactctttcctcaatcctaggattgattcccagccagcatcagacagcctccttagtcttttcctggagtgtagaatagtctggagataataatcttccttagtacgactgtaaaatactgtaatacaactgtaaaataaaatatagaaaaaattacagagggcaaaaccaatgttttttaa

SEQ ID NO: 19072 - DNA, 229 bp, Homo sapiens
actagctttagtttagaaatcgcaatagacatttctcaaaatccattctttacagagaagaccagaaacttttgaaatccaatttagattctttctgattaagcaacattgttagtagagagaagcatttctttgttttgctcatgtcctttgaagagtaaataactgctgactgtccagatgtaggtgttaggaaaatcagtgctgagctctggcctttggagccaga

SEQ ID NO: 19073 - DNA, 413 bp, Homo sapiens
ctgtgctgggaggtccgctgctgtcttcagagccgtcaggcagagacgtttaagtctgctataagcccctgactggggctgctgccttttttacagagatgccctgtccagagaggagaaatctcagttttatctttttcttatgtgggagtatacctgcagaataaattcatactttctctctttttatttctagaatggggattctaggaggacagtccatgttttattcatctctctgcgtctactgcccatcataatacctgacacataatgggcactctaaatgtttgtatgagtgaacttcagatttcattgcaggttgactcaataatttttaaacagaagattctatttcattacaaggactgcagatccaagccttgtcacctatcagacacacatgcacactt

SEQ ID NO: 19074 - DNA, 104 bp, Homo sapiens
tccagccccatcaggtgtcccaggccccgaggcatagactcagcctctttccccccaacctcgtgcccatctccttcttctctgaccattaccctgacccctct

SEQ ID NO: 19075 - DNA, 404 bp, Homo sapiens
ggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagagga

SEQ ID NO: 19076 - DNA, 2339 bp, Homo sapiens
caggagaggccgccacccggggttccggtggcgttaggctgcagcagtggcgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 19077 - DNA, 494 bp, Homo sapiens
ggactggatcccagtcccgcccctgtccccaagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggtaataatccatttcattactgtcttcaaaggtttatttgtttttcccatactcataacttttagtgcattttaaaagacatta

SEQ ID NO: 19078 - DNA, 2554 bp, Homo sapiens
caggagaggccgccacccggggttccggtggcgttaggctgcagcagtggcgcttcccgccgcccgagcttcggaaacttcccggccgcgacgcagggaaccggcgcggagaaccgagcagagcggaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaaggggcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 19079 - DNA, 2089 bp, Homo sapiens
gctagcttggcctcttccctaagaaataaagaaggcactttggggtccaaggtagggtacttagatgtggaagcaaggggccccggggaggggcggggaggcggcggagagagcccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 19080 - DNA, 690 bp, Homo sapiens
ggactggatcccagtcccgcccctgtccccaagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 19081 - DNA, 2441 bp, Homo sapiens
agtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 19082 - DNA, 3093 bp, Homo sapiens
agtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactgaaaagaaaaaaaaagacatacataataaggaaaagaaaacaaggggggcgcccaacgcttcaatagtagttctcccccctgcgggggcgccccaaagtctttccgacgggctacccacgtatttgtctggtccacacaaggtggcgccccttattgtgcgagcgagcatttatcaataacgctaaagcgagcaggtggccgctgccgtgtttccacaagacgggcggcgcgacagctgggtgggaaccagccgcgtgtccataaccgagtgaggcaatctcttggtgagtgagagagggcgacccctatataggaatctgcggggagggggcgggagaaaccagacatatatgtgcggcggaccacatacttatccgccccatcacaagaagaggagattttacaacgccgccctcaataagggggcggagcaatcttttctatcaacaggcttcctgagcacaagggcggtgtgtacgaaaatgcgcgcggggatgcaacaccagcgacaagcgctgtgagacaatatatatggtgcgttaagcgatgcgcgttctgagagaagcaacctctttagcgagcggatacccttaggggagcgttaatgttaaccctcttatgcgggacaggaacgtcattctttatatgacccg

SEQ ID NO: 19083 - DNA, 629 bp, Homo sapiens
ttttgtccatttttccgccaagctcaaaattacccccccttaaagggaccaaaagcgggaactcccccccggtggcggccctctctaaaattatgggttccccgggctgcaggcttgggtcttgatccctgtgaccatttggtgaaagttctggaccttttctttgagtgatgcatatatacatgctcagttatgttccggtttcagtctatccgttgatttgggtgagaatccctgatctagactctccctctcatccttaggcttaggctgtctatcactactgctatgccatccatttttcttcctgttttgatgcctgtgtttccttcctgcctctgctttttttttttttttaaatacaaattcagctgtggcatttttaaaatgggcttaattcccacctctctgcctttccaattgctgagttccctagcttaagtaatcagtgcccatccactcagattaatgttgttacttagttcccatatgatggaaagattgttttctccctgcttttgaggggtgcaggcggcaaattaaaaatgttcttctttaacatcttatgcagctgccttgctgtgatctgttgaaagtcagccctcaacatgaaggtttatgagaaaaag

SEQ ID NO: 19084 - DNA, 896 bp, Homo sapiens
ccagacgtggctctcacgagggggagaaatgatgtcccctgcaaatggccactaaaaatagcccacaatctctgcatctgtcccaccccaagttgcaaacccgaatgctttgagggcctggcaggtgacgtggaagagtgaggagggctgccttggcttcacagaagcatcctgagttgtactcttccaataaagacacactctatctgcatactaaatacataaacattgaggatccaagactattcttcacttctacatcaaacatgcacgctgtcttgtaacctcgtgtaaaagcaccggagggattgctccaggcaatgtcagagccttctctttttcttaatctgggaagaaagtggccaaggcatcctccaaaaatgcagaaattatttaatccctctcttccaagttctaagctgtgtcaacatcgtctaaaagcctccctagaatgaggaagtgaacagggaaaaaggagcccccacaacctgcagagactctgtgattccctgggtctcctaccaagacgccgggcaggtcacagttgcacattcaaagtaaacacagctggactaagaagaagaaaaagaaaatccatccttctgttttcatctctaaaagctagaaaactacactcttgcctatcaaatatagcctcgctccctctgctgccaatctggctctagtcgtcttcgctggcggccttgttcagagaaaggatgggctgaatctgtttaagggagaggaaggagaggagggagaggaaggagaggagagagaggagagggcagggcatgctcctgtgatagcctcacttccaggtctctgtctggtcctcaaagctttctctcttgttcagagccttcaatgttcacttcacaaaaggggaaacaaag

SEQ ID NO: 19085 - DNA, 886 bp, Homo sapiens
atagatttgaagtttcttaacctcaaaactctattttagctccaactagtattattttaaaataggtggtttagcaacacatatatccaaaaatggttagattctccagatatccagaatctaaaccatcatcagagtaaaaaggtaagaatatacttcaaagttttctcaagacaatcctggccagaatgcttaagtttgagtagtcaaatacttaacaaaatgaatataaaaaatttagcactagcaactaatcaacaaacatgaatataaatgctttagtatgaagaagccattgatagttgtaataactttgcattgttaattggtatcttacaaattacaacttatgcaaacaaaattatgttggtctataaatattggttaaatgaacatgtttcctgtacatttataaattctccatatgaaaaatactcatctgaaatgctaaaagcaaaaatgttatcagtagaaaagcagctattttatgactttttaaagcaagttatgtctgttatttttcacctgtttcaaaggaatgcataagatgcttttataagtgtttttgttcatgtataacatacttagcacttactacagatgaatgctgtagactacttaatttcaaatgcctacattttcaaaacaatgaagacatattactgaccataaaatggaaatagcaaccattcaaaatagttgaacatttattgtgtcatttactctacggaggcaatctcattattaaagaagttatagccagtttatgtgcatatgtaggtgcaagtatctataatgtacattataatttgtaactatcaaatatgtaagtgtaatgaatatcggtttattttgaatacaagcttatataaaacaaaaaaaaaaa

SEQ ID NO: 19086 - DNA, 296 bp, Homo sapiens
ttgcaccatcgtcaaaaatcaattgaccataaccagggtctctagtttgctaggattttgttgaggacttttgcatctatgtttatcaaggatattaccctgtaattttcttttcttgtagtgtcctagtctgactttgaatgtgtttaagagtgttctcccaggccggtgcagtggctcatgtctctaatcccagtgctttggaaggccgtaagtgggaggatcacttcaggccaggccaggagcttgaaaccagcctggaaaacagcaagaatccatctctataaaaagtaaaa

SEQ ID NO: 19087 - DNA, 605 bp, Homo sapiens
tcgagccggtccagtgctacctacacaaacagagtgctccggcgctacaaggaagcacactgaaaataacaagctgatgatacattatcacattgtacaatagtattttatattttcttacacactttccagtaagttttttcacatcctgaaatgtcacggtgtcatttttgaaaggagagctgtggagagattctgatatgactcagagttgtgaaggcacctggtggagctccttcattaatttctctaaccgttcagggcactgaagtctgtggggacagtaagttcacatttactgtttgtgttaagtgaatccccaacctactttgatttgcactaaaacgcctctaccctcaaagtaccgcgtcattaaggttatatgataacaaattaggaaaaacaaattaagcatcacttgcttggcaacattaactggcccaccacactcccaccacagattttagaagtgtacattagcaaaagatgcttctctatgcattatggcagaagtctattaaagaatatttaatttattgactaatatttctaataagcacattcagaggatactctttctacgttttatatactggctgtctgcc

SEQ ID NO: 19088 - DNA, 303 bp, Homo sapiens
ccagggcacagaaacattttcatggtataatggaatacaaagtacattaaactcctgggtcactctacagtaagcaacaagcctaactctgcttcttgtccccttttacattaagtagacaattaaaaacagctgcaaacatatttcccaaccactaaaatgcatatatgatctctatgtaaaatgatatttatgcaacatatagtctgactggttaattaatggaccttttgtgaattgacacagtcaatatatatgttttctgcacataaaaaatcaaaacaataaaacctatgtacaggt

SEQ ID NO: 19089 - DNA, 816 bp, Homo sapiens
agatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtt

SEQ ID NO: 19090 - DNA, 1320 bp, Homo sapiens
agatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgttaaaaaaaaaaaaaaaaaaaaaaaaaaaaaaaacacaaacaaaaaaaaaaaaaaaaaaaaaaaaaaaaaaaaaaaaggggggcgcggccccccgaccccccccccgggggccccccaccctcacgcgccccccctgttgttgttctgcagcacaaagggcggtcctcaaatacgaggaggcgttctatttatttataccgctcacgcgagagcgggccgcgcgcattaataaaacacaagcggtgtagatgcggagcaaaacctcgtcactcccgggtggacacctttggaggaaagagagcacccccttactctgtcggggggggggcgagaagaccaaccactgcgtgggagcaaacacttctcctccacggaagagtatttacttaaagaccctctatggaggggagaaaaaatctaaaacaatcttttctaaagagggcttgaactcagggtggggacttacaacactgctagccgcttaacttatgtgtctcgggccctc

SEQ ID NO: 19091 - DNA, 476 bp, Homo sapiens
atagattgtttttattaaacacttatgaatactgtttgaagtgctttaatttttataacaatcctatgaatttggtaataatcacattttacagatgaggaaattacccaagattatatagctaataagttgcgtggcagaaattagcatctggtatcagtttgcgatctttaccactaacacgatgtctgtgcatcatattaatcataatcattttctctgtcatatgttgaaagttattgtgccaaacattgtgctgagttttagaagcatgatctgatttgataaatctacaatgtaggttctattcttttacttcttgaggaaattttgagacccccaatgattaaataacttctttcccttgttcattgtattagactgcaattctccactcattatatttgatgccttttgcaatatggctttgtaatttttcccatcaggaagtaaagtctatttcctcaaccattaaa

SEQ ID NO: 19092 - DNA, 340 bp, Homo sapiens
tgaagggggactcctggggctggaggagtcggtaggacaatggccatgggaagcatggaggccatgctgacgtgcctggccttgagtctgtagaccttggcgtgaggaaagagctgatgtggcaagcaattgggtacgtggccgcagcctctgtcctgatgactgcttttactaacaggtgggattttgttctaggaaagcgcccccactgcctttaaataaaatggttgcagcagggtgcctgttgtctcagctagtcaggaggctgaggtgggaggctcacttgagcccaggagttctcgagaccagcctaggcaacatagcaggaccccatctctga

SEQ ID NO: 19093 - DNA, 348 bp, Homo sapiens
aaaaagagcaaaactccatcttataaaaaaaataaaaataaaaattagctggttgtggtggtgggcgtccgtaatcccagctactcaggaggctgaggcaggagaatcccttgaacctgggaggtggaggttgcagtgagcaaaggtcacgccacactgcactccagcctgggtggtagagcaagactcagtctcaaataaataaaaataaataaaaagtcagatctgccagtggtaataatgcttttagaaattttgtctttgattaccaggaaaaaccctacatgctagtccttatactccgtcgtgacatttggtaattaagtagagtgaggtggaatgatctcc

SEQ ID NO: 19094 - DNA, 398 bp, Homo sapiens
gtggacatttcactctgcaaagggttgatgagggtacacacagcaggcttcctgcatttccatgggtccacagcagccctggaagtcttagatctaagagtgggcctcactatgcctgttgtcaaacctctcaggtcaccaactcctctgtctgtcaaatggggatgcagtttttctcacccacttcacggagcggtttgagtactagatgctccgtaggcctgtgagccatttctgacgttattaccatgtccttggcagcagctatgtccccggttgactcagattcagtcccaggcagattaaaatcttcaaatgctttgcatatcagtggctgaccagccagtagcctcaccccaccctgccagcctccattgctaaatcatgcagtgggtgtt

SEQ ID NO: 19095 - DNA, 210 bp, Homo sapiens
actgcatattagcaatcacattaaactaaatgcaaggttttaggaatgaattaatgagaaagatgttctctctccttgcattagtaattaggtttgttatcttctcagagacctaaatcgcatcggcattaacgccgtggcagcacctagatggcagccatatgctgtcagggaacaaattagttcatgagcatcattaccagatcctaa

SEQ ID NO: 19096 - DNA, 599 bp, Homo sapiens
tataatttgttgtattttatcttatattaaatatttttaatactcttgatatctgagctgctcccagtggtccaattgtatgatgtcagaccctcatttcaaagaacttgcttatacaatacctatcatgagtactaatgactcatgtattttaatatcataactttgtgatatggaagtttattttgtcacgagataattgtgttcttcttatcatgtgccagatttctttcagtattttagcaattaacaaataaatatgggtgtgggttttgtaaaccaaataaagtatatatcaaaacattatcggctgggcaccgtgactcagtcctgtaatcccagcactttgggaggccaaggtgggtggttcatgaagtcaggagttcgagaccagcctgaccaacatggtgaaaccctgtctctactaaaaatacgaaaattacttggcgtggtggcgtgtgcctgtaatcctagctactcaggaggctgaggcaggagaattgcttgaacccggaaggcagaggttgcagtgagccgagattgtgccactgcactccagcctgggcaacagaacaagactccatctcaaaacaaaaaag

SEQ ID NO: 19097 - DNA, 456 bp, Homo sapiens
attcacagaggtgatgctctccccagaacctagttgcttccagctcagtgaggacacacacaggcaaatgagtcatggctgggttgagctgcaggttctttgaagcaggtatggggtgtaccatggggcccaaaggaagaaaacaccgtcccatggtttgtgagaaaggcatgaataatactaagaggtgagcactctggcacttgtggtgaccctggcagccctccaatgaaggagaatgttgtgacctcggctagcaaagtgtaaaagttttcactttgacagaggttgagttacattcaagtttctaaagcattccccagcaattccctccagacagcaactgagctatgaatctggaatttatttggtagggacttttctctctcagaaatgcagccaaacaccaaagaaaaagatcaccttttaaataaaagaagcacattgtactattag

SEQ ID NO: 19098 - DNA, 442 bp, Homo sapiens
gtaatcccagctactcggaaggctgaggtgggagaatagcttgaacccaggaggcagaggttgcagtgagccgagatcacgccattgcactccaacctgggcaacagagcaagactcatctcaaaaaagaagaagaagaagaagaagcagcagcaaatctaaaatgtaatccataaaagtaagaaattgaaaataaaggatttaaaaaatactagactgacacaaaccaaaacagaaagctgatagaccaaaaatagatttgtaaggcagaaagcattgttagtgatgaagaaagccattacataatgaagatgatgaagaaagccattaattacataatgaagaatggaataattcaccaggaagaaatagttatcttgaatctgtgtgtccaaataatattgtctcaaagcacataaagcaaaaatttgcaggcaaaaaa

SEQ ID NO: 19099 - DNA, 247 bp, Homo sapiens
ttcccagagaagcacacatactgaaaccatctgcatttgtgtgtggggagaagtttgcagatgtggggagtcacaggtcatttgaaattccaagattaagaaaccctgttacctttaagataaagtctgactccatggtatgacaaataaatcccttcccagtctggtcttaacccagacctcatttgccacatgtgcccactccccatccccctgcaggccattcctcagccaccatggcctttgg

SEQ ID NO: 19100 - DNA, 379 bp, Homo sapiens
ggctgggttaatgctgtttccttcattgctgcctcacaaaaagcctcctccaaggtcacctcactgctcctcagtttcccttcctttgggacaggctcaggaaagccgctcagtgtaaatctgtggcggaaccccaggccttgtgaagaggtagcagaatgggggcatctgctttcttctcttcgatatccaagtttctaaaaggaagaaaagggagaattacaaagcacatgcaagctcacaaaaatgtagatggctactgaggatcctaaagggcctgatcacaattcctcccttaatttaggggagccaagtgcttcccaatgtgctctgggaaaaacatgtgacacaaacatgcacttaggatatctaaacactg

SEQ ID NO: 19101 - DNA, 432 bp, Homo sapiens
actctgagtacttgattaaggtagcgtctgctggcttcctccttgtgcagttgccctttttcccttccacaactattttgtggggaggaactttgaaactattaaatattgtggaactgggcacagtggtggctcacacctgtaatcccagcactttgggaagctgagacggttggatcacttgaggccaggagttcgagaccagcatgggcagcatggcaaaaccccatctctacaaaaaatacaaaaatatttgctgggctgtggtggtgcgctcctttagtcccagcaactggggaggctgaggtggctggattgcttgaacctaagaggttgaggctgcagtgagctgagattgtgtcaccacactccagcctgggtgacacacaagaccctacctcaataaataaataaatattgtgttcctcttta

SEQ ID NO: 19102 - DNA, 250 bp, Homo sapiens
catttatctgaatttattggcaggtcagggtatccttctggaggtcagcaagtgaaataatttcttattactttacaagtggcaggtggtgaacagtgttacacaaaatgcgttatataaaataagtgtatatgaataaagatgtggttagtggatgccgttcagtgtgagtgcaaggtgtactcagaagctttttttccaactcaaagacaagaaatgaattccattgtaattgatccagtttttctct

SEQ ID NO: 19103 - DNA, 301 bp, Homo sapiens
tccattctgtaggttgccttttttaatgttgatagtgtctattgatgccccaaaagtgttaattttcatgaagtccagtttgtctggttttgtagttgttgcctgtgccttttggtgtcatagctcagaaatcaatgccaaatcaaatgtcacgacagttttgccccgtgttttcttcttagagttttataattttaggtcttacatttaggtcatggatcaattttgagttaatgtttgtatatggtgtaagataagtgtccaaattcattctcttgcatgtggatatccagttttccca

SEQ ID NO: 19104 - DNA, 477 bp, Homo sapiens
gtatcatggttatgaaagaaaatgcctttattctttaggaatgccttcacttaggagtgaaaggtcttatctaaaacttattttcaaatagttctgcaagtaaataaatgtgtaaacttatatagatattcatatatacatatatctataaagcaaatatggcaaaatgttaatgattttgaatgtaggtagaaggcatatacagtttattattaccattatattatatatattaacttctctttacatatcagattttccttaataaaaagttggaaaaattcaaacaaatccacaaaatgtcacggtcaattatacaaatacatatgatagaaatgtacttagcggcctatcacagtggctcacgcctgtaatcccagcactttgggaggccgaggtgggcgaatcacctgaggtcaggagtttgagatcagtctggccgacacggtgaaaccctgtctctactaaaaaaaaaaa

SEQ ID NO: 19105 - DNA, 319 bp, Homo sapiens
gtgaaatttgaagtcatgtcctctgatgctggagctaggaaatgaaaccattatattatattgtgtttctgtcaggtgacacatctctgagagaaatgctatcactaatatgatcatgaatagaagcattagattaaaacttgtttcatcagcctgaaatactgggctgaaatcaacacaatcattctggtgtaattgaatcaatcaaaattggttactttagaacaggattggagagaactgactttccaggaggtcttgaaaaagaaatactggtgttattgttgaccacagtcaggtaacttagcctagaaaaaaa

SEQ ID NO: 19106 - DNA, 850 bp, Homo sapiens
gtacagtggtgcgatcacagctcactgcagcctcgatctcccaggctcaagtgatcctcccacctcaacttcccaaaggattggaattacaggtgtgagccaccatgcctggcctcatagaatcttatacacttccttataaccataattgatttatcagactatttagcatgaatctcctgtacctctggagaacgtaagaggaacaacaacaggcaaggtccttgaatctcataatgattacattctgggggaaagagcattctagcagtactgtatctaatcaactggctaacagtttgtataattcttttttttttctttttttgagacagaaaactgcacaattatgattccgggatgatcagtaaattaaggattttaaacacacataaccacagcaataccttgaacgaaagactgaagagaatttctttgtctgctaagattacttgaaaaacaaaagaaaagaaaaatggtttaaattgttattacagaaggacaaaaccagaaaaggagagcctggaagaggaacaagacggtcacttccatctcttcctaaaaagacacagaaggcttcaatgccttcactgttgttttggattggaatggtgctgcaatgggaactgcaaatacaaataaacatgaaaacaacaaatgcagatgtaaaataaagacatgctagaaatcaaagaaaccgacctctaccagacacacccaggtctgggtgtacctttgcctgttcttcccgacttgcacagcccaagcaaggtggaaggagaaacataacaaaatgatacaggaaccagagagcagagggtcttggagcataaactgttaaaataataat

SEQ ID NO: 19107 - DNA, 633 bp, Homo sapiens
gttgtggtaaactcagtttctagacctaagaagagatggctccttctccttaatatttccaccctgagagagcctcttatcattgataattttaaaacataatttaaaaccctagacctctctctacaaccctagttactgttctctttacatatattctcccattgcaaccaaagttctatgaagaattctcaatactcaactcacatccctttgcacctccctccacctcagtcctcattcctcatctaatggtgctttgttcccgcacccctctgttgaaatgaaccccatcaaaaccaacagccacccctttgtcccatttatagatcaagagtgttaaaatgaacatctatatggagacaaagcttcccccgcaatgacaaaattcagttgcttttgtatagacaaagattatattgcaatgctatatttacctaaaagctagcattgtaaaatagcttccataagagtcagtcagataacgtgaaggctgtgctacaggaactgtgctatcagttgaagtacaacatttccccaacatatcccatactattgcttcaataaaaggaattttgcaaatagatttactgcatgttagcaatatttttatgatcacttcaataaattctg

SEQ ID NO: 19108 - DNA, 2504 bp, Homo sapiens
attttctggggaaagccttatttctatctttgccatccagtttgattttacaagacaatgctgtcccacctcaagacagtgctgaccccaatgaaccatccagtttccgatcatttcacctctaatacccagggataggtgagcatgttagtcagcagttccaacatccaggtgtggccttcaagtggtctctagagcagcactgtccaaagaactttctgtgatgatggaagtgttctatggcttatagactatactgagcaattgaaatgtggctacagcaaataaagaactaattttaattttaattaaaatgaaaatgaacttttaattgtaattttcattttaatttaaatagctgcatgtggcaatttaataccatattggacagataattctaaagtaatgatatctaatagaaatatagactggggctgggcacagtggctcacgcctgtaatcccaacactttgggaggctgaagtgggcggatcacttgaggtcaggagttcaagaccagcctggccaacatagtgaaaccccattgctactgaaaatgcaaaaaaatcaaccaggcgtggtggtgggtgcctgtaatcccaactactcgggaggctgaggtgtgagaatcaaaaaaaataataaaattaaaataaaaataatgtgagctggacttggtggcatgtgcctatagtcccagctacccaggcggcttaggcgagaagattatttgagcccaggagttaaagagaccagcctggggaatgtagtgagcctctactgtaaaacaaaacaaaacaaaagcaacaacgacaacaacaatataattacacaagaaattttaaattttctaatagctatatgaaagcagtatttaaaaagtgaaattagcctggcgtgcatgcccggccttccttgaagttttttgtttggttttgatttctttttggagattgggtctcgctctgtcacccatgctggagtgcagtggcacaatcttggctcagagcaacctctgccaagcgatcctcccgcttcagtctgagtggctgggactacgggtgtgtgccaccacgcccagctgatttttgtggttttgttagagatgaggttttgccatgttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactataaaaaaaaaaaaaaaaaaaaaaaaaaaaaatttggggggggggggcgccccaggaaaaatttttgaaacccaccctgttggggggggcgggggaccccagtggtaattgagaacatggggcagaacggggcgggcagaaggacactgggggccgagacaaaggccgcgggcgtctgtcccccaataaaaaagccgcggggcgaccgcgcgggttctggaaccaaacccaaaggcgccgaggcaccaccgggtccacacccaggggcccagcgagcgtaaaaatgcagcgcgcggatgtaaaccaccagaccatgcaaacagcagacgtgacagcacaagacgaaccatcccccacgactagacgcacaacccccgacacactctaggacgacaccaactagatcagccaaatcgcgcgcccagcaacatgcacacaacagacacaccggccgccgacgccaccgtgtccacacgtgcaacagacccccactgcgcgacagcacgcacgccatcaaggcccacatcagggtctgtgcctgggacaagaccacagcctgccgacagacccgacaccgcacgactgccacaccgcctgcgatgcacccgcgctcacgtcgcaccacccagaacagcgcaacaaccaccgcacgcaccgcctcgcgccccacccccccccactcaagcccccaacac

SEQ ID NO: 19109 - DNA, 1806 bp, Homo sapiens
attttctggggaaagccttatttctatctttgccatccagtttgattttacaagacaatgctgtcccacctcaagacagtgctgaccccaatgaaccatccagtttccgatcatttcacctctaatacccagggataggtgagcatgttagtcagcagttccaacatccaggtgtggccttcaagtggtctctagagcagcactgtccaaagaactttctgtgatgatggaagtgttctatggcttatagactatactgagcaattgaaatgtggctacagcaaataaagaactaattttaattttaattaaaatgaaaatgaacttttaattgtaattttcattttaatttaaatagctgcatgtggcaatttaataccatattggacagataattctaaagtaatgatatctaatagaaatatagactggggctgggcacagtggctcacgcctgtaatcccaacactttgggaggctgaagtgggcggatcacttgaggtcaggagttcaagaccagcctggccaacatagtgaaaccccattgctactgaaaatgcaaaaaaatcaaccaggcgtggtggtgggtgcctgtaatcccaactactcgggaggctgaggtgtgagaatcaaaaaaaataataaaattaaaataaaaataatgtgagctggacttggtggcatgtgcctatagtcccagctacccaggcggcttaggcgagaagattatttgagcccaggagttaaagagaccagcctggggaatgtagtgagcctctactgtaaaacaaaacaaaacaaaagcaacaacgacaacaacaatataattacacaagaaattttaaattttctaatagctatatgaaagcagtatttaaaaagtgaaattagcctggcgtgcatgcccggccttccttgaagttttttgtttggttttgatttctttttggagattgggtctcgctctgtcacccatgctggagtgcagtggcacaatcttggctcagagcaacctctgccaagcgatcctcccgcttcagtctgagtggctgggactacgggtgtgtgccaccacgcccagctgatttttgtggttttgttagagatgaggttttgccatgttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaatacca

SEQ ID NO: 19110 - DNA, 1751 bp, Homo sapiens
attttctggggaaagccttatttctatctttgccatccagtttgattttacaagacaatgctgtcccacctcaagacagtgctgaccccaatgaaccatccagtttccgatcatttcacctctaatacccagggataggtgagcatgttagtcagcagttccaacatccaggtgtggccttcaagtggtctctagagcagcactgtccaaagaactttctgtgatgatggaagtgttctatggcttatagactatactgagcaattgaaatgtggctacagcaaataaagaactaattttaattttaattaaaatgaaaatgaacttttaattgtaattttcattttaatttaaatagctgcatgtggcaatttaataccatattggacagataattctaaagtaatgatatctaatagaaatatagactggggctgggcacagtggctcacgcctgtaatcccaacactttgggaggctgaagtgggcggatcacttgaggtcaggagttcaagaccagcctggccaacatagtgaaaccccattgctactgaaaatgcaaaaaaatcaaccaggcgtggtggtgggtgcctgtaatcccaactactcgggaggctgaggtgtgagaatcaaaaaaaataataaaattaaaataaaaataatgtgagctggacttggtggcatgtgcctatagtcccagctacccaggcggcttaggcgagaagattatttgagcccaggagttaaagagaccagcctggggaatgtagtgagcctctactgtaaaacaaaacaaaacaaaagcaacaacgacaacaacaatataattacacaagaaattttaaattttctaatagctatatgaaagcagtatttaaaaagtgaaattagcctggcgtgcatgcccggccttccttgaagttttttgtttggttttgatttctttttggagattgggtctcgctctgtcacccatgctggagtgcagtggcacaatcttggctcagagcaacctctgccaagcgatcctcccgcttcagtctgagtggctgggactacgggtgtgtgccaccacgcccagctgatttttgtggttttgttagagatgaggttttgccatgttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgta

SEQ ID NO: 19111 - DNA, 1759 bp, Homo sapiens
attttctggggaaagccttatttctatctttgccatccagtttgattttacaagacaatgctgtcccacctcaagacagtgctgaccccaatgaaccatccagtttccgatcatttcacctctaatacccagggataggtgagcatgttagtcagcagttccaacatccaggtgtggccttcaagtggtctctagagcagcactgtccaaagaactttctgtgatgatggaagtgttctatggcttatagactatactgagcaattgaaatgtggctacagcaaataaagaactaattttaattttaattaaaatgaaaatgaacttttaattgtaattttcattttaatttaaatagctgcatgtggcaatttaataccatattggacagataattctaaagtaatgatatctaatagaaatatagactggggctgggcacagtggctcacgcctgtaatcccaacactttgggaggctgaagtgggcggatcacttgaggtcaggagttcaagaccagcctggccaacatagtgaaaccccattgctactgaaaatgcaaaaaaatcaaccaggcgtggtggtgggtgcctgtaatcccaactactcgggaggctgaggtgtgagaatcaaaaaaaataataaaattaaaataaaaataatgtgagctggacttggtggcatgtgcctatagtcccagctacccaggcggcttaggcgagaagattatttgagcccaggagttaaagagaccagcctggggaatgtagtgagcctctactgtaaaacaaaacaaaacaaaagcaacaacgacaacaacaatataattacacaagaaattttaaattttctaatagctatatgaaagcagtatttaaaaagtgaaattagcctggcgtgcatgcccggccttccttgaagttttttgtttggttttgatttctttttggagattgggtctcgctctgtcacccatgctggagtgcagtggcacaatcttggctcagagcaacctctgccaagcgatcctcccgcttcagtctgagtggctgggactacgggtgtgtgccaccacgcccagctgatttttgtggttttgttagagatgaggttttgccatgttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtttcacttgaaaataacatgaatgagacgaaagatgaaccagattacttggtgacgcacgtcgacgcg

SEQ ID NO: 19112 - DNA, 379 bp, Homo sapiens
cttttcatttcagcatttttacaatgatgttcctagctgtgttttcattgcatttatcctgtctagggtttatggtgatatttgaacccatggcttatttctttagtaagttctgaaaaattctgtcttttcaaatattctgtgccttttttctctctctcttctctcctccaattacgcatgtttgatgtttgtgctctgtcccacacttttcttatactctttttatttttcattctttgttctcttttatttcaatctgaatattttctcctgacctacatccagaccactaaatctctctttagctttggataatcatttaatcatcatattaaattaatattttattttaattaattaaaaattaaaataatta

SEQ ID NO: 19113 - DNA, 686 bp, Homo sapiens
acaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttc

SEQ ID NO: 19114 - DNA, 545 bp, Homo sapiens
gtagcagagagatacgtgttcccgttcttttccctcgaaaaaacacctatgtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttc

SEQ ID NO: 19115 - DNA, 660 bp, Homo sapiens
atttcaagggttgtgggacttcagaagagagaaagacgtgggctggacatcaaagaaggcctgccagaggaggtcgcgtttgagctggacctcgaaagatggcaggggactttccacaggcagagattggaggtggtgctagttatgaagccagacaccttcagtttgaggctgtgatctgtgaggacagtggggagaggggaaagccagagaagggtaaaaggctgaggaaaccctggccaccttctctagtaagaggacaccaaggatcacgctttgcctgctttaacatcttgcctaccattgccctgatgaaaataggccactgttttgaattagctaaaagttgagaactcagacttggatttgacaagggccctctgagggcagttaaaccaactctcagccccatgattctatgagtctgtgattcgcaggtggagccaatgacacacctttgggactagcaaggcctcttggtcagcgaattccctcaggggaataatgctccttcacaggagaatggcagatggaaaaaccccaaaaagtgaatatgcccaggactgctcaattgaatttacaatagttccagattattgactagctcatgcctgtcagcagagccagaatggacacatactttgaagagtatgatggcag

SEQ ID NO: 19116 - DNA, 1055 bp, Homo sapiens
  misc_feature (934)..(934): n is a, c, g, or t
  misc_feature (972)..(973): n is a, c, g, or t
  misc_feature (1040)..(1040): n is a, c, g, or t
gccctgtgttcctccagcccctactgagggcaaagtgcctggcacagaaccaaggagctataactttcccaggtgagactcgcttctgacaataccgtcagtcagtcctctagggttcccatctgctgggttccctgctcatatggcccagggaatgttctctgtaggatgctgcacagcctgtggacctctccagaggagaagaggacaaaggagagagtgtgctgcaaagttactgtaatcatactaataccaacacgctggaacatttactgtgtgtgctagctattgttcaaagactccactctctatatggcagctcctagccacatggctatttaatgaaatgtaaattaataaaaatcaaaatttataattcagtctttcagccacacagccacatttcaagtgcttcatagcttcctgtggctggcagctaccgtgtccaacagtgcagatctagaacatttccattgccccagaaggctctgttgaacagtgctgttgtgagagctttgtttgtgttgtctcatttacaccaatcctgtgaagtggattccgttattttatcattttacagataaggtaccaggggcagcaaagagttaatgacttgacaatttatagcttagtagatgaaagaactggatttcaaacccaggttgaatggctcagagcttttttctcttaggcatcgtgctacacttattcctgtatagcatggacaatttgtttctgctctgttgaaggtttaggggaagacattgttaaagcttggccagaattaatctctcatgtttatttggattatctttgttattcttactcacttttcccaagcacctctctacatcctccataccaccccttacaccaccaacttttttcgtaacaaaaaatgatctggccaccgcgcctggcctaatttttgtanttttagtagagatacaaaaatacaaaagataccggganncggagcttgcagtgagctgagattgcgccactgcagtccgcagtccggcctgggcgacagaagcganctccgtctcaaaaaa

SEQ ID NO: 19117 - DNA, 1156 bp, Homo sapiens
gccctgtgttcctccagcccctactgagggcaaagtgcctggcacagaaccaaggagctataactttcccaggtgagactcgcttctgacaataccgtcagtcagtcctctagggttcccatctgctgggttccctgctcatatggcccagggaatgttctctgtaggatgctgcacagcctgtggacctctccagaggagaagaggacaaaggagagagtgtgctgcaaagttactgtaatcatactaataccaacacgctggaacatttactgtgtgtgctagctattgttcaaagactccactctctatatggcagctcctagccacatggctatttaatgaaatgtaaattaataaaaatcaaaatttataattcagtctttcagccacacagccacatttcaagtgcttcatagcttcctgtggctggcagctaccgtgtccaacagtgcagatctagaacatttccattgccccagaaggctctgttgaacagtgctgttgtgagagctttgtttgtgttgtctcatttacaccaatcctgtgaagtggattccgttattttatcattttacagataaggtaccaggggcagcaaagagttaatgacttgacaatttatagcttagtagatgaaagaactggatttcaaacccaggttgaatggctcagagcttttttctcttaggcatcgtgctacacttattcctgtatagcatggacaatttgtttctgctctgttgaaggtttaggggaagacattgttaaagcttggccagaattaatctctcatgtttatttggattatctttgttattcttactcacttttcccaagcacctctctacatcctccataccaccccttacaccaccaacttttttcgtaacaaaaaatgatctggccaggcttggtggctcacgcctgtaatcccagcactttgggatgccgaggcgggcagatcacaaggtcagaagatcgagaccatcctggctaacgtggtgaaaccccatctctactgaaaatacaaaaaattagccaggtgtggtggtggatgcctgtagtcccagctacttgggaggctgaggcaggagaatggtgtgaagctgggaggtggagcttgcagtgagctgagatcacgccactgcactcc

SEQ ID NO: 19118 - DNA, 382 bp, Homo sapiens
tctcctgcctcagcctcccaagtagctgggattacaggcacctgccaccaagcctggctaatttttgtatttttagtagagatggggtttcaccatgttggccaggctggtcttgaattcctgacctcaagtgatctgcccaccttggcctcccaaagtgctacgtgagccaccacgcctgaccttctacaaaaaactttttaaaaatttacccaggtttggtggggtgtgcctgtagtcccagctacatgggaggctgaggcgggaggatcacctgagcccaggaggtcaaggctgcagcgagtcatgatcgcaccactgtactcagcctgggtgacagagctcttgctctgtctcgcggaggggaaaaaaagagagagag

SEQ ID NO: 19119 - DNA, 414 bp, Homo sapiens
tccatttggccctgttctgtcccaacatgaaggcaataatttgttacctcattaatggatctatccttttacttttttaaccacttccttatgctacccatgaaacctagttggggctctgttgtgtctgatttcccctggcgtattctttactttttcctccttttccaggctcagcagggagctgctggaggtagtagagcctgaagtcttgcaggactcactggatagatgttattcaactccttccagttgtcttgaacagcctgactcctgccagccgtatggaagttccttttatgcattggaggaaaaacatgttggcttttctcttgacgtgggagaaattgaaaagaaggggaaggggaagataagaaggggaagaagatcaaagaagaaaagaagaaggggaag

SEQ ID NO: 19120 - DNA, 440 bp, Homo sapiens
gaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtggaatcaagtgaaaaaggaggaccaagaggcaacaggtcccaggctcagcagggagctgctggaggtagtagagcctgaagtcttgcaggactcactggatagatgttattcaactccttccagttgtcttgaacagcctgactcctgccagccgtatggaagttccttttatgcattggaggaaaaacatgttggcttttctcttgacgtgggagaaattgaaaagaaggggaaggggaagataagaaggggaagaagatcaaagaagaaaagaagaaggggaag

SEQ ID NO: 19121 - DNA, 683 bp, Homo sapiens
cctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaacccaatgccaggctgcgcagtgaagaaaatgagtaggcagctcatgtgcacgttttctgtttgaatagatgttactgcaattgctgatgctgtcctagtactcgaactgaactctagcttaccttgaatcatcgctgaattgaacacagtcatgtttaggacctgtgtaggtggcttttgcacaatggatttagaatgctgaagatagatgttgcccggatgacgttcatatggtaactctgtctaagggggtcaggtcaagtagctgcccgttgtt

SEQ ID NO: 19122 - DNA, 1113 bp, Homo sapiens
cctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaaatcttactgtgccgagatcgctcacaatgtttcctccaagaaccgcaaagccatcgtggaaagagctgcccaactggccatcagagtcaccaaccccaatgccagcgtgcgcagtgaagaaaatgagtaggcagctcatgtgcaacaaatcttactgtgccgagatcgctcacaatgtttcctccaagaaccgcaaagccatcgtggaaagagctgcccaactggccatcagagtcaccaacccaatgccaggctgcgcagtgaagaaaatgagtaggcagctcatgtgcacgttttctgttttaaataaatgtaaaaactgccatctggcatcttccttccttgcattcttaagtcttcagcttcttggacaaacttagtattgccaccagagatcgtgctttcgcttaagcccctttggaatctcccatattggaggggatcagtaacaggacactcagtcccttgaacaggggaatgtggcctacaagtgcaccagactagcccttagtcatctccagctcgacgctgggctatgagccgtacaagacatgggcccctcacaacaagggtaggtcccgagcacacctcgaacgaacgctagcggcgtccaaggtcaacaacgaacgccattccttaagccctgctccgcgaaaagtcaaggtgaccacggcatgccaatgcgcaccccccccgcaaagcgcgaacacaccgcatggcacacaccacacggacaccacacacgcacatcacacgcagcccacacgacccgaacaaccaggccacacaaaaagacgaaccaa

SEQ ID NO: 19123 - DNA, 968 bp, Homo sapiens
cctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaacccaatgccaggctgcgcagtgaagaaaatgagtaggcagctcatgtgcacgttttctgttttaaataaatgtaaaaactgccatctggcatcttccttccttgcattcttaagtcttcagcttcttggacaaacttagtattgccaccagagatcgtgctttcgcttaagcccctttggaatctcccatattggaggggatcagtaacaggacactcagtcccttgaacaggggaatgtggcctacaagtgcaccagactagcccttagtcatctccagctcgacgctgggctatgagccgtacaagacatgggcccctcacaacaagggtaggtcccgagcacacctcgaacgaacgctagcggcgtccaaggtcaacaacgaacgccattccttaagccctgctccgcgaaaagtcaaggtgaccacggcatgccaatgcgcaccccccccgcaaagcgcgaacacaccgcatggcacacaccacacggacaccacacacgcacatcacacgcagcccacacgacccgaacaaccaggccacacaaaaagacgaaccaa

SEQ ID NO: 19124 - DNA, 370 bp, Homo sapiens
cgcccgccaccacgcctggctaattttttgtatttttagtagagacggggtttcactgtgttagccaggatgatcttgatctcctgacctcgtgatccgcccaccagacatcattctgtatttgcaacccttatttgtggacatttataaaactgacatgagttcatgaatgcttcctgtgagaagtgtgcttctaagaaaggagtcagcttttatatgtggaaaagccaagctgtggtctgtgggaaatacatatgtgttagatacaaccttgcctaggaaacttgcggggtttattccagcctagggaattttccttctcttttcctcccttttcttcatacttaagaacccatgaaactagtgttct

SEQ ID NO: 19125 - DNA, 420 bp, Homo sapiens
cgcccgccaccacgcctggctaattttttgtatttttagtagagacggggtttcactgtgttagccaggatgatcttgatctcctgacctcgtgatccgcccacctcgacctcccaaagtgctgggattacaggcgtgagccaccaagcccagccagacatcattctgtatttgcaacccttatttgtggacatttataaaactgacatgagttcatgaatgcttcctgtgagaagtgtgcttctaagaaaggagtcagcttttatatgtggaaaagccaagctgtggtctgtgggaaatacatatgtgttagatacaaccttgcctaggaaacttgcggggtttattccagcctagggaattttccttctcttttcctcccttttcttcatacttaagaacccatgaaactagtgttct

SEQ ID NO: 19126 - DNA, 4739 bp, Homo sapiens
agctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19127 - DNA, 4578 bp, Homo sapiens
agctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaagtaatgtaaaaaaaaatgttgtgtgggggggtgggggcccggaagaaaatttaaaaaaccacgctgggggggggggggcccgaaaggtggtgaggggaaattgtggcaaagtgttcaagaaaaccgggtgtgcatggggtgtggtttccccaaaag

SEQ ID NO: 19128 - DNA, 4322 bp, Homo sapiens
ggatttatcataaaagagacatttgattgattgattgatttccttctgtgtaggcatcaggcataagatttaagtacacatccatttttgaaaatgaaaccagaaggatttttaagtattactggctttctaaagccaagtcctaggcagttctgctcccgtggcttttcgtggcctgactctggtaaggcattccaaggctgctctgactcgcagttcatagaagagaccaaccagctcagtattcatagttgttccttccggaacagcacttgagatcatcagtgctagctgccaactagaattctgaattggtgacatcttttttttgtttaaagcaccatgattactcgattactcgattactcacacatccctctacttactgagtcttgtggaagaaaacaagagtcttctttttctagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19129 - DNA, 4079 bp, Homo sapiens
tttcactgcgcgacccgttttcttcttgcgttggagtatcggctttgtgcttttccctccacgccgtgatttctcactacctgggagcgcctggtccggctccgactgtgtctgcgtccagcgtgtaattgggcaggtctgccccgttgcctaggttgagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19130 - DNA, 4175 bp, Homo sapiens
agctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgatt

SEQ ID NO: 19131 - DNA, 2671 bp, Homo sapiens
gactgctgggatcaggtgccatctccgccataatcaaggtgataagtctgtccttcaatgtcgcaggtgcttttctaaagagtaagtgctggcacacagggctcaggctgggtcggcccatgattgtggatggtgcctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19132 - DNA, 2230 bp, Homo sapiens
actctataggatcccccacacacctgagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19133 - DNA, 1166 bp, Homo sapiens
  misc_feature (16)..(16): n is a, c, g, or t
cacttacaactactanattcgcgggcggcgtcgacgtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19134 - DNA, 1070 bp, Homo sapiens
gcggccgctactactactactactactaattcgcggccgcgtcgacgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggatattgtt

SEQ ID NO: 19135 - DNA, 461 bp, Homo sapiens
agctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagtacattacaggaatatcagaagagaatgaaaaaactagatcagcagtacaaagagaggatacggaatgcaggtaaggctcctttaaatggcaatgaatcatct

SEQ ID NO: 19136 - DNA, 494 bp, Homo sapiens
aatgatcccgtccccatcccagacaagaggaggaaacctgctccagatatccatttacatcaagccttaaccgcctttcttttttaagactgtggaatcctatgtttatccgtttgctagggtacacatggccgttgtcctacagaaaatagtaacatttaactggaaagcgtgtgttaaatgtttgtccacaggtcaggggttgctcattttatcatggtagtcctcatttgctactgcttttggtgggagagatgtatagagttgtgatttggaaaggtgctttgcatgcaaagttcagcctggttttaatgctaacatcaagattcaggggcatctgaaaacttgatgtgccttaattttttcacctgtaattttccaccttccaactgtaaaatgaaggcagtaatatctacctttatgtacctctgttatctatgtccataatgtagtggattgcaacctgtttttaaattaaagcaaatgagatttca

SEQ ID NO: 19137 - DNA, 475 bp, Homo sapiens
ctgtatcaaaaataatagtaactttttgaatatacacaatttatctagaatctattttcctttgaagctgtaactttatgagcgattatttactacctttgagaaatgtgttttagtataaaatataggatgtggaagcgaaaaaatatctgggtagcaagtgaggtgtactcaaaaataagcaaaagtcacgtgggtctgattttataccctcgctggaaagcttgttctcagacacactgttactgcaagtgtgtgtgagggggaaactctcacacactttgcagttgaggacagggctagactttgagttggagccctggctcccagggctgtgtactcccagcccgtgtttctcttttgctcagactgaacaagtggaacgaaattacattaaagaaaagaaggcagcagtgaaagaatttgaagacaagaaggttgagctgaaagagaacctgattgctgagctagaaga

SEQ ID NO: 19138 - DNA, 672 bp, Homo sapiens
gggtccgtggggcatgaacctctgaatgcatcacttggcagaaatcctctgcccatcagccgagtactttactccttagttcctcattcaaaacatgatgaggccgggcgcagtggctcacgcctataatctcaatgctttgggaggcctaggtgggcggatcacttgagctcagcagttccagaccaccctgggcaaaatggtgaaaccctgtctctaaaaaaatggaaaaattagccaggcatggtggtgtgtgcctgtggttccagttacttgggaggctgaggtggaagggtcacctgagcatagggacctgtgatcacagcactgtacttcagcctgggggacagagtgggaccctgtctcaaaaaaggaaaaaacaaaaaacaaaaaccccatgattaacaaactcaattaacctacacaggcttagttattgttcctaggacatagaaggttggaaagagatagagcaaagtgagctgtgagaattgatagcagaggctctgactctacaaaagtaaatagtaactcaaaagttgacaggcttagaatactatagtaaaaatagtaataataatggatgtttgataaatggtctaagatcagttctctctctaagaactcaaggaattataaacctactcagaaattatttctatcagaggatta

SEQ ID NO: 19139 - DNA, 3313 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19140 - DNA, 1937 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtcaaactcgcatcccctgccgtgaaacagatgccccgctagaagccgggagtggacagcatcctcctctccatagaattggagtgctcattagtggcaagaatcctaaggcgaactttgcctgtttaagtggaggagattagtcactgagataataaaataaatgcatgtgaaagtgttta

SEQ ID NO: 19141 - DNA, 414 bp, Homo sapiens
aaatgtgcagcaggcaggctggtatagtgaaggagatcaacattgcccggcacgaggccaatttctagtccaacaatctcatctgttaggcagtgattgttttacagatgcagaaactggcactcagaggatatgagtgacttgggcaaagccacatggctggggcctggctgcacttgggttcagtgcttggagctatggcaacttcctcacgtccatttcagtcttttcccttaatgctcacccctgcttccactttcagtcatgatcagccgcacactggggcccgaggtcgggggcagcattgggctcatgttctacctggcagactcaccggcccactggggtggtgatgttttcgttctgttttatttttctaactctgctgaccatgaataaaagaccaaaacacta

SEQ ID NO: 19142 - DNA, 6942 bp, Homo sapiens
  misc_feature (1784)..(1784): n is a, c, g, or t
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcggtgagctgggtgctgccgtggcagggatctcggggtgaggggtgggcagacgtcgggccgggcccgtaaaacctctggatgagcacaggtgtcagagggaatggagggcaggaggtctggactgcagagcagtgcaatttaattcaagcctgtctagcgtgtgcttggccggcagggcaggaggaagcccacaaaacagtccctgctttagaggaacttgtgttctagctgaggagagacatgcattcaggaatcagttaaatagcacagaatggcccagcatgacttaaacagatcaggatcacccaggagtggagagaagggaggcctgactatgggctggggagggcaggagccggggagctggaggtggcctgagatagacaggtgggggattcagccaggagctgggagcagagagggaaggcatctcaggaaagagcttgagaccaggtgcggtggctcacgcctgtaatcccagcattctgggaggccgaggcaggaggatcacctgaggtcaggagtttgagaccagtctggccaacatggtgaaaccctctccccgtctctactaaaaacacgaaaattagctgggcacgctggcttgcacctgtagtgccagacactcgggaagctgagggagaactgattgaacccgggaggaggagccgagattgtgccattcagtgagccgagattgcaccattgcactccagcctgggagacagtgaggttccctctccaaaaaacaaacaaacaaaaaaaacaccataaaataaaaatacaaaaattagccaggggtggtggtgcgcacctgtagtcccagctactcaggaggctgaggcatgagaatctcttgaaccngggaggcagaggctgcagtgagctaagatcgccaccactgccctccagcctgggcttcagaacgagactccgtctcaaaaaaataaataggctgggtgcggtggctcccgcctgtaatcccaggactttcggaggtcgaggcgggtggatcacctgagtccaggagttcgagatcagcctggccaacatggtgaaaccccatctctactaaaaatacaaaaattagccaggcgtggtggcgggcacctgtaatcccagctacctgagaggctgagacaggggaattgcttgaacctgggaggcagaagttgcagtgagccgagatcgcaccactgcactctcgcctgggtgacacagcgagactccatctcaaaataaataaataaataaaattaaaaagttagatgggcatggtggtgcacacctgtagtcccagctacttggcagactgaggcaggaggatcgctctagcccaggaggtagaggttgcagtgagctacgatggtgccactgcactccagcctggatgacagagccagaccctgtctctaaaaaataaataaataaataaaagagcgtggattagggtctggagggaggaatatcggagcactggggggacgtggcaatgtgtctggctgacccagggccagtgcaggaacaggctggggtcttagtgagggcagtgcaggggaggcaagaggaccgtgggaatgtgtggagagggtggctaagaggcctggatccctgagacggatgctgatgcactctcctccctgggaggatcctcctagctggctatgctgaggactacaccacgggagccgtgatgaattttgccagcgtctttgctgtcctctttaacggctgtacaggcatcatggctggggccaacatgtcaggtgagagtccctgcctgctgcctcctgggggtttggggctgccaccgtgagggacccagggggatggctggagggctgacctcactccctctgctccccctctccaggggagctgaaggaccccagccgggcgatccctctgggcacgatcgtcgccgtcgcctacaccttcttcgtctatgtcctgcttttctttctctccagcttcacttgtgacaggtgtctggggagggatgggggtggagtgtcgaacaagattggtgcacctgggtcaccaaggggaaacacaggctgggggactgggaagcagaaacccagcttgttggggtggagggtggctaccggcgattgacaacctatagccagcagctgccatggacccagtactgttgcaggcacttagcttgggagtgagggtgggtagtggctttctacccagtttgcatttccacaaatatttggcctcttgtgcatataccattaggtatgacagccgggtgcggtggctcacacctgtaatcccagcactttgggaggctgaggcaggaggatcgctggagcccaggagttccagaccagcctgggcaacagagcaagagcctccccccaaatacaaaaattagccaggtgtgatggcaaatgcttgtagtcttggctacttgggaggctgaggtgggaggattgcttgagtccaagaggtcgaggctgcagtgagctatgattacagcactgcactttagcctgggggttggagtgagaccttgtctcttaaaaaaaaggaaggaatgaccactgagtgattaaatccaaggctgcccaatgaataccaggcatatccctttagcacatttgatatctgagtctgatccttaagatcggggctggagattttcttaccccgtgacgcatgatcatccgtgtcctccttttcctccttcctaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggtgggttctctgcctccttgctggcttggagcacgccctcccttgtctgtctctccgtccccgctgagccctggctgatgtgtctgctgtggattctgtttttctaggcgtgatcttggcaccggccaaggttgtgtcccgagggggaaacccctgggcagctgtactttattcttggggcctggtgcaggtgagccttcttcttcaaggggccctttccctcaccccaccagctggcaggatgggggtgcagttagatgcaggctgggagacaaatgtaaagacaaatgcgtatgcacttggggttgcactggcactctgcagggttcactggcactttgtggggttcaccagcaccttgcaggttgccccagtgctttgcagagttcattggcaccctgggaggttcactggcactttttggggtacacgggcattgtgcagggttcactgacactttttggggtatactagtatttttcagtattcactggcactttgtggggtgccccagcactttgagggattcactggcactctgtgggatgtaccaacactttgtgggggttcactgatactttggaggtttggtggcactctgtgggagtgcattggccctttctggggatcactgacattgggggtgcacttgcactttacagggctcacgggcacttttcagggttcattgacactttggggtgcactggcactctctggggttcattgacactttgggggtgcgctggcactttgcatggttcactggtactttccagggttcactgacactttgggggtacactggcactttctggggttcactgacactggggatacactggcacttttggggtttaatagcattttaggggctcattgacactttgggggtgcactggcacttttggggtttaatagcattttgggggttcattgacactttgggggtgcactggcactttgcagggttcactggcactttctggggctcattgacactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccggtgagagactcagatctgtgtccccagagagaagaagggaggactcgggctcaggcgtggggctggggactgcagcctcgtgtgcggcctgccctgagtttctgtccctcctcccctccatgcccgcagccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19143 - DNA, 4829 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccggtctgtgctctgtccgatctgggcagtgctgcgggtttacagggtctgggagtgtgggatcatgagggagaaggtcctctccagcagaggggcagactgagccattaccttggctttctggagcttctgctgtgtggccagcatcgtgcaggagatatggacatccctgagattgtccttgcctgcagggagctaaccatctaatcggagagaccaggctaagattcttaaaactgacagagaccaccagggagagctaagatgctaggatggagctaagagggaagtggggaaggtggactctctgatagcaggtgggcagaggagggcttgtcttgctttgggtcacagttggggctgggtcccttcttatttatttatttattttgagatggagtcttgctttgttgcccaggctggagtacagtggtgtgatctccgctcactgcaacctttgcctcccgggttcaagcaattctcccacctcagcctcccagtagctggactacaggcatgcctccccacacctggctaattttgcagtttttgtggagctggggtttcacaatgttgcccaggttggttttgaactcctggactcaagcaatcctcccacctcggcctcccaaagtgctggaattatagatgtgagccgcccaccatgcccggctggtggggtgccttaggatcgggccttctaactctgtccctacctctctccagatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcaggtgagccttcttcttcaaggggccctttccctcaccccaccagctggcaggatgggggtgcagttagatgcaggctgggagacaaatgtaaagacaaatgcgtatgcacttggggttgcactggcactctgcagggttcactggcactttgtggggttcaccagcaccttgcaggttgccccagtgctttgcagagttcattggcaccctgggaggttcactggcactttttggggtacacgggcattgtgcagggttcactgacactttttggggtatactagtatttttcagtattcactggcactttgtggggtgccccagcactttgagggattcactggcactctgtgggatgtaccaacactttgtgggggttcactgatactttggaggtttggtggcactctgtgggagtgcattggccctttctggggatcactgacattgggggtgcacttgcactttacagggctcacgggcacttttcagggttcattgacactttggggtgcactggcactctctggggttcattgacactttgggggtgcgctggcactttgcatggttcactggtactttccagggttcactgacactttgggggtacactggcactttctggggttcactgacactggggatacactggcacttttggggtttaatagcattttaggggctcattgacactttgggggtgcactggcacttttggggtttaatagcattttgggggttcattgacactttgggggtgcactggcactttgcagggttcactggcactttctggggctcattgacactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19144 - DNA, 3263 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagaaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19145 - DNA, 1201 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttgaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19146 - DNA, 4124 bp, Homo sapiens
aaatgtgcagcaggcaggctggtatagtgaaggagatcaacattgcccggcacgaggccaatttctagtccaacaatctcatctgttaggcagtgattgttttacagatgcagaaactggcactcagaggatatgagtgacttgggcaaagccacatggctggggcctggctgcacttgggttcagtgcttggagctatggcaacttcctcacgtccatttcagtcttttcccttaatgctcacccctgcttccactttcagtcatgatcagccgcacactggggcccgaggtcgggggcagcattgggctcatgttctacctggctaacgtctgtggctgtgccgtctccctcctggggctggtggagtctgtgcttgatgtcttcggggccggtctgtgctctgtccgatctgggcagtgctgcgggtttacagggtctgggagtgtgggatcatgagggagaaggtcctctccagcagaggggcagactgagccattaccttggctttctggagcttctgctgtgtggccagcatcgtgcaggagatatggacatccctgagattgtccttgcctgcagggagctaaccatctaatcggagagaccaggctaagattcttaaaactgacagagaccaccagggagagctaagatgctaggatggagctaagagggaagtggggaaggtggactctctgatagcaggtgggcagaggagggcttgtcttgctttgggtcacagttggggctgggtcccttcttatttatttatttattttgagatggagtcttgctttgttgcccaggctggagtacagtggtgtgatctccgctcactgcaacctttgcctcccgggttcaagcaattctcctgccttagcctcttgagtagctgggattacaggcactcaccaccacgcctggctaatgtttgtatttttagtagagacggggtttcaccatgttggccaggctggtcttgaactcctgacctcaagtgatccacctgcctcagcttcccaaagtgttgggattacaggcgtgagccccggcgccctgccccttctttttttttttttttcttgagagaaggtctcactctgtcaccaaggctggagtgcagtggtaccatctcggctcaatgcaacttctgcctcccgggctcatgcgattctcccacctcagcctcccagtagctggactacaggcatgcctccccacacctggctaattttgcagtttttgtggagctggggtttcacaatgttgcccaggttggttttgaactcctggactcaagcaatcctcccacctcggcctcccaaagtgctggaattatagatgtgagccgcccaccatgcccggctggtggggtgccttaggatcgggccttctaactctgtccctacctctctccagatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19147 - DNA, 5999 bp, Homo sapiens
  misc_feature (2812)..(2812): n is a, c, g, or t
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccggtctgtgctctgtccgatctgggcagtgctgcgggtttacagggtctgggagtgtgggatcatgagggagaaggtcctctccagcagaggggcagactgagccattaccttggctttctggagcttctgctgtgtggccagcatcgtgcaggagatatggacatccctgagattgtccttgcctgcagggagctaaccatctaatcggagagaccaggctaagattcttaaaactgacagagaccaccagggagagctaagatgctaggatggagctaagagggaagtggggaaggtggactctctgatagcaggtgggcagaggagggcttgtcttgctttgggtcacagttggggctgggtcccttcttatttatttatttattttgagatggagtcttgctttgttgcccaggctggagtacagtggtgtgatctccgctcactgcaacctttgcctcccgggttcaagcaattctcctgccttagcctcttgagtagctgggattacaggcactcaccaccacgcctggctaatgtttgtatttttagtagagacggggtttcaccatgttggccaggctggtcttgaactcctgacctcaagtgatccacctgcctcagcttcccaaagtgttgggattacaggcgtgagccccggcgccctgccccttctttttttttttttttcttgagagaaggtctcactctgtcaccaaggctggagtgcagtggtaccatctcggctcaatgcaacttctgcctcccgggctcatgcgattctcccacctcagcctcccagtagctggactacaggcatgcctccccacacctggctaattttgcagtttttgtggagctggggtttcacaatgttgcccaggttggttttgaactcctggactcaagcaatcctcccacctcggcctcccaaagtgctggaattatagatgtgagccgcccaccatgcccggctggtggggtgccttaggatcgggccttctaactctgtccctacctctctccagatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcggtgagctgggtgctgccgtggcagggatctcggggtgaggggtgggcagacgtcgggccgggcccgtaaaacctctggatgagcacaggtgtcagagggaatggagggcaggaggtctggactgcagagcagtgcaatttaattcaagcctgtctagcgtgtgcttggccggcagggcaggaggaagcccacaaaacagtccctgctttagaggaacttgtgttctagctgaggagagacatgcattcaggaatcagttaaatagcacagaatggcccagcatgacttaaacagatcaggatcacccaggagtggagagaagggaggcctgactatgggctggggagggcaggagccggggagctggaggtggcctgagatagacaggtgggggattcagccaggagctgggagcagagagggaaggcatctcaggaaagagcttgagaccaggtgcggtggctcacgcctgtaatcccagcattctgggaggccgaggcaggaggatcacctgaggtcaggagtttgagaccagtctggccaacatggtgaaaccctctccccgtctctactaaaaacacgaaaattagctgggcacgctggcttgcacctgtagtgccagacactcgggaagctgagggagaactgattgaacccgggaggaggagccgagattgtgccattcagtgagccgagattgcaccattgcactccagcctgggagacagtgaggttccctctccaaaaaacaaacaaacaaaaaaaacaccataaaataaaaatacaaaaattagccaggggtggtggtgcgcacctgtagtcccagctactcaggaggctgaggcatgagaatctcttgaaccngggaggcagaggctgcagtgagctaagatcgccaccactgccctccagcctgggcttcagaacgagactccgtctcaaaaaaataaataggctgggtgcggtggctcccgcctgtaatcccaggactttcggaggtcgaggcgggtggatcacctgagtccaggagttcgagatcagcctggccaacatggtgaaaccccatctctactaaaaatacaaaaattagccaggcgtggtggcgggcacctgtaatcccagctacctgagaggctgagacaggggaattgcttgaacctgggaggcagaagttgcagtgagccgagatcgcaccactgcactctcgcctgggtgacacagcgagactccatctcaaaataaataaataaataaaattaaaaagttagatgggcatggtggtgcacacctgtagtcccagctacttggcagactgaggcaggaggatcgctctagcccaggaggtagaggttgcagtgagctacgatggtgccactgcactccagcctggatgacagagccagaccctgtctctaaaaaataaataaataaataaaagagcgtggattagggtctggagggaggaatatcggagcactggggggacgtggcaatgtgtctggctgacccagggccagtgcaggaacaggctggggtcttagtgagggcagtgcaggggaggcaagaggaccgtgggaatgtgtggagagggtggctaagaggcctggatccctgagacggatgctgatgcactctcctccctgggaggatcctcctagctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19148 - DNA, 2657 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtggctggctatgctgaggactacaccacgggagccgtgatgaattttgccagcgtctttgctgtcctctttaacggctgtacaggcatcatggctggggccaacatgtcaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagggttcactggcactttctggggctcattgacactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccggtgagagactcagatctgtgtccccagagagaagaagggaggactcgggctcaggcgtggggctggggactgcagcctcgtgtgcggcctgccctgagtttctgtccctcctcccctccatgcccgcagccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacacta

SEQ ID NO: 19149 - DNA, 2519 bp, Homo sapiens
ggctccaggcctggcatcccggtagccgcagctgtcttttccggcccccgtgcactctccgcccgaggcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttgactgaggacagcatagacgacaccttcctcccagtgcctgaatacataaaccagtccgttcccaaaaggcccgc

SEQ ID NO: 19150 - DNA, 585 bp, Homo sapiens
gccatgaggaggtgtcaatagagattagagatggtctttgtgctgtgagagagacctcacatttccaaatgccaagtcctttcttcctcagtcaaatgtaccccctagaacatagatacctactaagctgtagatttttgaggggatacagagctgaatccataagatagtggattattcagataagaatttctgtagatagagagtttccaatcaattatgtaccccaacaatgtgaggtcaactacttagactacctcttagcttctacatttagatgtttcaaagtctgttctgatccttaaatttgacacttctctttaatataaacaaagcccttttagtattctttgggattagcttaccacttaataaattccttccaacactatcttctgtgagtcaacaaacagcttcctcctgtgatttgggcctggctaacaacaagttagacttcagacgaataattactaggctgaggcattttccaggtggtacattcccactttgaggaaacttggtcattttacttttgcatttaagatgtccttaggctgaaaataaagtgtcagtgtttgaaatgtc

SEQ ID NO: 19151 - DNA, 393 bp, Homo sapiens
ggctctaccaacacgccagctagtccctacctcagagctacccacagtgacctttctagagaaatctccattaaggcccaaagagagcccattcatttcattctgtggaccctaggtccaggaagaaacatccttacggactctcagcaccctttgcgtaacagtaacagcttggcactcacccaccagagaccacttccacaacagaaagaggaccttgctgtcttctccctcttagaagaagggcaggagaactcatgcatagcgtatttcccaaaggctggcaaagaatgtaatcccagcctctgggtgtgggcaagtccatcctaaaagctatgctggcttaggtgggccacagtaggaaaaagtattttctgcagtacagagatgttt

SEQ ID NO: 19152 - DNA, 944 bp, Homo sapiens
aaaagattggacagataaattgttccttcaatggcaatgaaaatggatgttacagagatacatggatacatggaacaccctgagtgaatcttacatttattttgcagaagatatcaaaccaaacagagcacatattattccattcatgtaaaggtcagtaacagccacatataaactatattttggagattcatacacaatagaaaaaactatttaaaaagtcagataatactgattttaaaaatcgggatgttgaattcatctgggtgttgagggaggagcacattgtgacccagacagagcactcaggactctgagcacactaatactctgtattgccttcagtggtagttacatcagtatcaacttaagaaaaatttattaaaatctacataaataataaataattttctatatgtatgttatatttcccaatgctatgaaatgaattgtgtctccccaaaatgtatgtgttgaagtcctagcccccagcacctcagaatgtgaccgcatttggagatggaaccctttttttttatttttgagacacagttgcccagactagagtgtagtggcgtgatctcggctcactgacctctgcctcctggctcaaacaattctcatgcctcagcctcctgaggagctgggattacaggtgtgtgccaccgcatatggctaatttttgtatttttagtagaaatagtagacgccatgcataaataccaattctctccaaattgatctatttctcaatctacacatattctactggtgatctcatccaaggttgtggctgcaagtacaccactacaagccaaaaaattatgtgtatatctccatctcaggcttgtcttccaaactccatggtcatatatctaatattgtatttcttcttgtcttctctttgtatttgtgtagaacaaaagaaaaaaaattttaaagta

SEQ ID NO: 19153 - DNA, 348 bp, Homo sapiens
tgtgcaaaggtgggaaagaccagagtgaacaacggccatttacgttctgaacatttactcagtctttcaattggtgtgactgacaagctgaagtgcaatggcaaatagagacagcagagagtgcacaatcactaatgtgggactgttagccaaggagtggagaggtatgtgtgggaaagaaaccactctatttcagcagtggaagtgagagaagaccacatccactctcttgaaccaaatcaaatagctcatgaatgacactttggctttatttcaaaataatttttatgcaagtattgagttcacaagactgtcacctggacaagaggcaatgaagatgtcatttct

SEQ ID NO: 19154 - DNA, 425 bp, Homo sapiens
ggcttggaattgttcaagctgtttactgttttttaaccaatactcccagctttcctctaaaaaaaattaatagctttattttaaggtctgtatattgtgtaaataaatgacattaaagagatacgggtttttactattgtttgacaaaggtttcttgggacttctctcaggagtgacatattctttgtcagtatctgggggacaatagaagagggattattactaaacctatcattactttagtcatcccactttacaatatgtctgaactcagaacgttcctaatatatgggccagaataccttgttcctaataccactctttgcccttaataggaattacataaaacagagaagccataaaactatacctcaggtttatgagcagagacaaagggttttattaaaggcttaccagataccaat

SEQ ID NO: 19155 - DNA, 189 bp, Homo sapiens
ttcattgttgtgggagtgggctcctgctaaaaggataagtttggcccccatcttgtctctctgtctaatgtgcttgcttccaccttccactcttctccatgggatgacccttgtcagatgcttgtgctatgctcttggacttcccagtctctagaaccatgagtcaaataaatttcttttctttataaa

SEQ ID NO: 19156 - DNA, 545 bp, Homo sapiens
tcgattccatgtctttgctgttgtgaatagtgtgctgcaatgaacatgtgcatgcgtgtgtgtagaagcacttgatttcaagctaccaatttccatactagtctaagtaattaatactaactgttcatggaagacaaacttccaaactctcaatgttgaatgcagcaatgtatttctcacattataattggatgtggatgaggcatccttccttcatctaaagcttagccacctgggaatgccgggtgtctgaggtcacaaagaccatggtgaagggaaggactaatggatgtgttaccctagcttttaaccatcttgtcccatagttaatacacaccactcttgcttgcgtctacttgctgggaactagtctgatggctccaatctcaattcaagtatggctaggaagtttaggagaacacatgtaatatttggtgaggattaaatctctttctcacactattacacatcgagcttcctttgtaaaactgctttcacatcccatgattaatattaatctcactgtttcctagaggtgagacagc

SEQ ID NO: 19157 - DNA, 374 bp, Homo sapiens
ttcctttagcattaatgaatgacattcttttaaacaagactgtgtcctaaggatgaatcacatgagtgacaattgataacgtgaattttaatattttaaaaaattgattaaggccaaaaacgccagagtaatcaggacagtgtggaattagtataaggacagacttgagagcccagccacagacttgcaggtgtagtcacccggtgtgtggcacaggggccacagcaatgacgcagggggaaaatggtcctgactcagttggaaatttgtataaaagtttgcttgcagatggattactgacttaaatgtaaaagctaaaacaataaggttttagaagatggcatggaaaaatattttcatgattgtggaatggg

SEQ ID NO: 19158 - DNA, 294 bp, Homo sapiens
aggttacaattctattccaggaatgattactgtgctctaggtgacagaatactagagcttatctagtgtaggtcagacagctgcctctggggtcaggagagtggggtctgtgatcatagaagggagttgaggaagaaaaggggacatggaggtgtagaagatttaaattttgtggctgggtgcagtggctcacacctgtaatcccaacactttgggaggccgaggtgggaggattgcttgagcccaggagtttgagaccagcctgggcaacgaagtgagacttggcctccacac

SEQ ID NO: 19159 - DNA, 302 bp, Homo sapiens
ggcgtgcagcggcccttctccaagccactctcgggctgtgctgtccaaggctgtgcgggaggagggcaggtgggaaggttctgacgttgcagagccccccttcctccctccttgtcctccctcttcaagttcctcccttccccagctaagagccccccagccattcctgatcgatgggcccaggcatggcaggggtgagggggtgggagagtggttcttgaggacggctgggcatctgcaggggtccaggcctggctgactggaggggctggggccccgggggttgggaggcacagtgggag

SEQ ID NO: 19160 - DNA, 907 bp, Homo sapiens
tatacatacaatttctgcctattgatgagtatgtacacccacgagaccagtggtttgtaactgagggagggttaatagttttgttctcttccaaggggacatttggcaatgtctggaagcattttcgactgtcaggactgggaggatggtgctactggcatttggtaggtagaggccaggcatgctgctgggcatccagtagtgcacaggacagccaccgcaggaaagaattatccagtccaaaatgtcagcaatgcagcctttgagaaacccaacactgaacaatgagcctctagtgcctctttttgtctcactgcaaaaatgggcttgggttcaacatgggcttcctatattttatcttcccattatagtactggtgggtgtatgaaacatgaattaatagaaaatggtgttttctggaagaagtcaacaaggaaggtgagctatgaattagtggcatagcaggtaactggtattgtggacagagccagaagtttacaacagacctggtagtggatttgtttatgggctttggggaaatggactgttttgaaccctaggaagtctagctttttttgggtaaacatcacctcttaaatgttaactcttctaagtgatggattattaaacaggtgctgatgaaagcatcttaataaaacacatcacacagttgtgttactccttcacgctgagctctgcctaatgaagattggctgtgtagagccactactgcttcattttgttgcattttgtatacacagttcagaaaattaagagacaagggaactagtattgagtagaataataaaaggactttcttgaatgatggcacttctgattttttttttccctgccctacgtgactggacgaataagggaggaagatgtcatggggcctctaaacagc

SEQ ID NO: 19161 - DNA, 1055 bp, Homo sapiens
  misc_feature (42)..(42): n is a, c, g, or t
ggatgctggggacacacggggcacagtgcagccagaggttgngccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaaaaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttt

SEQ ID NO: 19162 - DNA, 1001 bp, Homo sapiens
  misc_feature (42)..(42): n is a, c, g, or t
ggatgctggggacacacggggcacagtgcagccagaggttgngccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccattccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaaaaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttt

SEQ ID NO: 19163 - DNA, 239 bp, Homo sapiens
ccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgat

SEQ ID NO: 19164 - DNA, 585 bp, Homo sapiens
tccagatcaaggccagtttgcacaaccttaggcccaagggacagttgtttgcaaggggtgtgcactgagtagattgatgtttgcactggtgtttccaccgacgtttaaaggaggatgttcatgctggggcacagaacccaggtggaaagggaagaactgtgggtcagactttaattggtgtttcccacccaggaatacatattttaggggcaggtctgggcatggcacagctgtctgctatctctgcctcacttactctgcggaagtaaacaaacccccctgggttaacccaagtctagactgtgtccagcagctgtttcttgtgaggtagccctgagtagtgttgcttgtcttttgacctggtggctcaattggctaatatcccaaggtgcagaggacccccactgaggatgctgagtgggatggacctgtcctgcaggagcgggcgtgcttgccctctaatgcatttttgctttttgtaagaaaagaggacaaatgtctaatgtgcttttcagttcttttccaaattcagacaatagaggaaattagaggggattcaataaacccagaatattgttgtgtagc

SEQ ID NO: 19165 - DNA, 418 bp, Homo sapiens
gttggaaagtccaaattcagtgtgtgttgaacttcaggcaagtgttcatgaaaatgtacctggaactagtgggccctcctcgctgtttggctccagatcacactggccacgagttgtcttctcgggggggtggatccgcggtcaccagacttcatgccttaatagaacaaaaagctatggtctgcgctgggcgcggtgggtcacacctgtaatcccagcactttgggaggccgaggcaggcacatcacttgaggtcaggagttcgagaccagcctggccaacatggcgaaaccccgtctctacaaaaaatacaaaaaaccaactagaaaaccgagttccgatgcctggttccccaccaccccacctgcttccagtccagttaaatcaaaatcactagggctggtgtccaggcactttg

SEQ ID NO: 19166 - DNA, 948 bp, Homo sapiens
actgcttttttaatctttagatgtgtatattttacatttgttagggaacacagagtatagtctacagcattgtgtacatttcattacctgtcatcttttagcttaaaataataaatgtttcgcaagtgccacccccttcaaaaacatctcatgttctttcctactgtggatgactgagatggtgtgaatatttattgatttgtttaaatgtgtcaaccattatatggtacctgtaacccaagactaaaagttttttttttaatgggttctgcaaatggaatataaaaattggttatcattttattatttatttttgagacagagtctcattctgttccccaggctggagtgcagtggcgggatatcggctcactgcaacctctgcctcccgggttcaggcgattctagtgcctcagcctccccagtagctgtgattacaggcgtgtgccatcacacctggcaaatagtagagatggggtgacggggtttcaccatgtcggccaggctggtcttgaactcgtggcctcaagtgatctgcccgccttggcctccaaaagtgctgggattacaggcatgagtcacaacgtccagcccaaaaattggtttataattaaggaaaatgcagcacaatgtttaactgcattaagttattggataaaaagacaaatacacttgtaggagagcttctgtggtttactgttcgaaggcacaaatgcctgttgctttggcttccatatcagtcagtataaaaatcacttgatgtgctttgtgcaaaatttccaggaccttatgttttatatgggtgtcatgaagtgaatggctgaaagctcttcatagaaggaaggtggtttacatctgtgtgcctaggtgagactgttttagtaggtttcatagcagagtaacaaacaggagaaaacagcttctaatatttgtcatgatgtagtctta

SEQ ID NO: 19167 - DNA, 575 bp, Homo sapiens
gtaataatgacattgtggttatgttacaaaaaggagtcatttcagaaacagactgaaatatttacaaataaaatcatgtgttgtctgggacttacttcaaaataatgtgtgagtgtagggaatgggcagggttgcagtagggacaggattggccatgggttgatggttactgaggctgagcgatggcatgtgaggttttattattttattgtttactttcatctattttcaaaaagttaaaaaatcagccctccctttgctgaaaaaagaaaaaaagaaaagaaaaactacaggttttgtccctgcctcctggagctttcagttgtagagagaaagcaacacttactgagaaactaaaagatgatgtgtgttgtaaaatgagagtgcagggtgacattgcaattgagcaagctatcttgaggtagagagagaaggtagtcaaagattttgttgacagtttagttagaactaaaattgatagcgccattgtactccagtctgtcacagactgagatattatctcttaaaaaaaaaatggccgggcttactttgggaggccgaggcaggtggatcac

SEQ ID NO: 19168 - DNA, 598 bp, Homo sapiens
ttcagtgatggattttgcttccaggttttcagattataagcaattctgcaaaatgtcattatctggttggaactaagttcatataattgtcttaatggcatgcttaactagcttttgcaagtacagttttcttcagtatgtttctactgacctgatcattcaaaacactcttttaatgttttctaccaagccacacctccttcttgatggtaaggacaaaaacaactatgagatatttcgtattttgaatgccccacaaataaacagatattccaaatacggcagtgaattaaatgttttcaatagggggaaaatgaggaatctcctgtcaggaaatgcccaagggaaaggttgttatggaaagggaaaacatccattatgggcaagtttcttgtttacacaaatttcgggttattacagatcagaccatgtcccttgaactaccactgcacactgggaaaattcattcattcatagtagcgtccttccacacagtattcagttttccatttaccttgtttgctaacacccacgttataaagagttgtcactgattacataaaggatggtttgccaatcaggatatgcatacatggcc

SEQ ID NO: 19169 - DNA, 491 bp, Homo sapiens
atcttacacctcagctattacaactctgctttcagacttctctggaaaagtaaagtgcacattttccagaaaattctttcagagaaaatattgctgctggatgccagatatctgtctaagacctgtagaaatagtcgtttcaagggtacaagatccaggctcccagattagccttgaaactatcattatttcatcctagctttgcttaatattattttttaatctttttgcaaatctcccacacctgtttgatgagtgttaattcctgcattgtttccttgatgctgtcttcaacctagaccacattaaggaacctgctcaattcagttagctgggtgtggtgcctggcacctgtaatcccagctactcaggaggctgaggcaggagaattgcttgaacccaggaggcggatgttgcagtcagccgcaattgcaccagtgcactccagcctgggcaacagtgagactccacctcaaaaaaaaaaaaaaaaa

SEQ ID NO: 19170 - DNA, 425 bp, Homo sapiens
atgactccatttatacacacagaatgcacgtagatgtttggatttgtcttaattatccgacagatggcataaatactttccggcagtctgctcagtggggctgtgctgacttgggaggttagaaacaaactgagcccgtgactgccaggtaccactcgtgtctccatatttcccatgcagcaatagctcctgctgtagtcacagtgactttgcaagcctacccaaggggaatgtagacaatttagtaggaaaataatatttcttaccaaaatgtcttggccaagcacagtggcttacgcctgtaatcctaatactttaggaggctgaggtggggaaatcacatgagcccaggaatttgagaccagcctgtgcagcatggccaaaccccctctctacaaaaaatgagccagggatggtggcacatg

SEQ ID NO: 19171 - DNA, 600 bp, Homo sapiens
ctctgttgcccaggctggtctcaaactcttgggctcaagcaatactcctgtcttggcctcccagaatgttgagatcagaggcatgagccatcacactcagctgtttttaaccatttaaaaatgtttaaattctgtggcattaagtacattcatactgttgtgcaaccatcaccaccatccacctccagaactttttcattttccccagttgaaactctatacccattaaatactaacttctattccatccttccctcagcccttggccaacagcattctactttctgtctctacggatttgacactttagtagcctcatgtaggaagaatcataatacttgtctttttgtgactggcttatttcacttagcataatattttcaatgttcatccattttgaagctccatgtgagtgggcaggaacttgttaactggaggccttcactgagaagtgataaggtgatgaatacctgccaggtgcagtggctcacacctgtactccagcactttgggaggccaaggcaggaagatcatttgagcccaggaattcgagaccacccttggcaatatagtgagaccctgtgtctaccaaaaaaaaaa

SEQ ID NO: 19172 - DNA, 161 bp, Homo sapiens
aaccaccatgcacactgcctttcacgtacacatgaatagaaaaggcaggctgtaaatattcagggcccagtgacttacaaaagtaaatacctgatctgtaaggaaagtagcaagtctgattgcatttaattaatttaacttcccttttaaaattcatcttc

SEQ ID NO: 19173 - DNA, 453 bp, Homo sapiens
cccacagtaggtattaatgggagtttacctttactaagtaatttttgcatatatgtgatatttaaatttgtttacattgtatatatcactctaagaataccacagagtataatgtataattaaatacagatgaagaaaatctaataaattaagcacagtcaattcctgatgattttatattagggttatctcccccacccgccaacttaaaacactccaaggccactgttacctggctcttatactcaaaacgatcaaaatatttttataaggagcttagtaataaaaacaattcactattgtttcctcattactcagcacgtggtagatgtttcatgtatttatgtgtatatagagagatacatatatctctacacacacacacacacacacagacatatatataatgaaagagatccatacttaaagaataaagaagaaacataatttttg

SEQ ID NO: 19174 - DNA, 412 bp, Homo sapiens
ctgcccatcactgtccacatttctatcagcattttggttataaccacttaaccagtttctaaggatctccaaactttccctcatcttcctgtcgtcttttgagtcctccaaactcttccaatctctacccattacctagttccaaagccacttccatattttcaagtatctttatagcaacatcccactcctggtaccatttttctgtattaggctgtttttgaatttccatgtagaaatacccaaggctaggtaacttataaatgaaagaggtttaattggctgacctgtagatgaggcctcaactggtgaggcctcatcaagcattcaatcatgttggaagtgaaaggggcagacagtgcatcacatagcaagagtgagaacgagagagagaggagaggagccacatact

SEQ ID NO: 19175 - DNA, 409 bp, Homo sapiens
ctactaaacttgacatggctgagaggttgttatggtatacagttgcaaagatgagaagacaccttatttatcagtttgcttggccgatttataatttaagaaattttaacagattgtataagagtctttatttgaatttttgccccagggactgtaatttggggagtatcttgaaattcccattgtggtttcagtttagaaccttttgtatcgtccactggtgtctctaattaagaaccctgcaatacagtgggctctattataaatagtacacatttatctctgtaaatttcaaatcctgttaattgatattatccttattccccaaaccacattttaatttgttgtagtttttaaaattcattatgatttcaagaaactttatgtggaaatcatataaattatctca

SEQ ID NO: 19176 - DNA, 707 bp, Homo sapiens
ctgttcctgcttttccttgtagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19177 - DNA, 1838 bp, Homo sapiens
cgggcaggtggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19178 - DNA, 2086 bp, Homo sapiens
cagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19179 - DNA, 354 bp, Homo sapiens
  misc_feature (109)..(109): n is a, c, g, or t
ctgaagtcctataaaaggaagccagggtgtgacattttgagcgagtcatttccaatagccgtggatcagttgacacccacatttccttgtgtgcctgatccggtttttntgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19180 - DNA, 1868 bp, Homo sapiens
  misc_feature (16)..(16): n is a, c, g, or t
  misc_feature (19)..(19): n is a, c, g, or t
  misc_feature (23)..(23): n is a, c, g, or t
  misc_feature (29)..(29): n is a, c, g, or t
  misc_feature (98)..(98): n is a, c, g, or t
atgcggcattttgttnggntacnaccatnatgaaaccccggttgtgttttaaaaaaccagtgacgcccgaatacggatgaagtacgagtcggtcactnagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19181 - DNA, 1204 bp, Homo sapiens
tctgaaaacaagttttatttaaataagggtttaaatacattacacataacattaaaactgaaggggaaaaaaaaaccaaaaaccagtttgttacttcacatggcattgggcagctgctgctattaagttgcaagctcttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19182 - DNA, 1878 bp, Homo sapiens
  misc_feature (29)..(29): n is a, c, g, or t
  misc_feature (1546)..(1546): n is a, c, g, or t
  misc_feature (1549)..(1549): n is a, c, g, or t
  misc_feature (1570)..(1570): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacaagggggggggnccnccccccaaaaaggccccaaanaaacctgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19183 - DNA, 1734 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacacagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19184 - DNA, 1682 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19185 - DNA, 743 bp, Homo sapiens
ccggagccagacgtccgctgtgccgtcctcacagcaaggcctgctccgaggccccgggctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19186 - DNA, 358 bp, Homo sapiens
  misc_feature (46)..(46): n is a, c, g, or t
ggcctgccagggggaggaggagcctggagagtcccttgcccggggncaggtcctctgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19187 - DNA, 301 bp, Homo sapiens
ggactgggagagaccgataggagtggaggcaggaaggctgtcagtcgggccatcgtctttccctataggctcttgagtgtgtgggatgggaggaaggcaagtgctctgtggtatcgggcaggtggggaacctccctgaagagtgccctggtcacagcacccttgaagacagccattggccatgggtcagtgttgagtttggttggccctgtgacacgctggagctctctttccagtgcggtatcctttgccctggtgggtggagggggtctcaggcttgtgtgtggatgatgctggagcga

SEQ ID NO: 19188 - DNA, 1838 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19189 - DNA, 2904 bp, Homo sapiens
cagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcaatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctga

SEQ ID NO: 19190 - DNA, 2867 bp, Homo sapiens
cagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19191 - DNA, 2742 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcaatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctga

SEQ ID NO: 19192 - DNA, 3136 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcaatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctcaccagggcctcctgccaccacctggactgtggaaggccactgagatgggggcagagctcagcccgaggcttgggcacactgcttctctccacggcctgtgggtcctggatctgagcccttggggtgtttcactcaagagccactgagccgtccccatcttccacaaagcagtttccacaagcaagccagggccagccctgcctgcactctgcccgcagtgcccctcaacgtctgggatgaggatgagcctgctgagatgagggcagctctctccatccagcagtacctcatggagtgctcactaaggagttaggaatggcaggccacgctggcatctggggttcaaggtggctcctgtggcaggaacaggtgtccatgaccctgattacctggatctcacaggttctgggaatgcaataggggcctgctgtggctattccaacatctctggtcagggcctggaagtaccttaggacacatggggttggggtcaggactgcattctcagggaccagtggagagccctggaccagatgaactggagtctaggcctctctcgtgactgggacttgtgggacgtgggaggcctgtgagatccaggactaaagattatgctgtttcctaatgggcagatatgtaagtaggtaagtgggatcctcaggtaagcgggatccagaactaaagactgtgctatttcctgatgggcagatgtgttgtttctacctcatcttgggcagcacctggatatgctggcgctggttcatcactggaggagcctcttgtattttgagccctcggacatgctccagagggtcctgacggtcacccagcaaagagggggtacctccatggtgctggcaccaaagacagagatgggcacagctccaggctcgtgaaaatgagctctctataacattgtcttcctgaggtttttcctgcccttatccaaggtgggccctaaagctcagtccccagcccagcagcacctctgggtgccggggtggaggatgacgaccagagcagctctctggagaggtgccctgtagtcagtcccacagctctctggtgctacccccgtccccagcagcctgtgcc

SEQ ID NO: 19193 - DNA, 2143 bp, Homo sapiens
  misc_feature (29)..(29): n is a, c, g, or t
aaagcaggctggtacggtctgaggtgtangatctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtaagcgaactgacccagagaggccaggccaacaccaaccaggttttcctaagactctgacgtccagcagcctctctccgtggcccaccctgggctcagtccccacaaagtaaaacgagatggtagaagccctcttcccgggactgcacggcaatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggccctgtgagatccaggactaaagattatgctgtttcctaatgggcagatatgtaagtaggtaagtgggatcctcaggtaagcgggatccagaactaaagactgtgctatttcctga

SEQ ID NO: 19194 - DNA, 651 bp, Homo sapiens
aggctcacttacaggcagctttggaggcaggcactgagatggcctgttgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaac

SEQ ID NO: 19195 - DNA, 755 bp, Homo sapiens
tcaaccactctacacgctgtatatatacaatttattccgaacctcgattatcggggaaatatactccttgaggccccaagaatttgcgaccctcagattaaatacccaggaatactcctttcatcaaacaagggggatcgggtgggacacctccctcagcctcctgagtagctggaactacaggtgtgtgccaccacacccagctaattttttgtatttttagtagagacagggtttcaccatgttggtcaggctagtcttgaattcctgacctcaaatgatctaacggcctcggcctcccaaagtgcagggattacaggtgtgagccaccctgcccagcctactttttctttttaaagaatttattttaattgggtttcgtaaatgcagggatacaaaagctattggatcttgagatagctttgtattttgtagagaatcatcccaggagcacattccctcactgagggttccagccacctcttccgcctcattatactttgcttagcaccgagaagtctggcatcgtttctgttggaatgaaaagattggcagagctgccctggacaacagcactgcaaaacactgtggcagaaggtttggtctacataccaaggcagccaaagtattaattgcattctctgtgatcacaaaataaggcgctgaattattctcttcatgttttaagaatgacaggcttttgctctgccagctccaagcatagtgcatcacatggaaaggagatgctagatttg

SEQ ID NO: 19196 - DNA, 714 bp, Homo sapiens
ccctgcgggccctgcctcccacccaccccatcaccagctttccacttggaggccccctgtgccctgcagcctcagggtaggccgtgggtcaccaggctggagagggcccctgccttggccaggggtgcgaggtgacccggctgcattgctgggtgggagctgctgtctgttgttcaggggcctggcccccgccctcccccccgaccccgacctcgcaaagcgcactcccgggcagggtgtggtctggaaggcggggctggcggggacatgggtgttcctgcatctcctagcgcagttcctgctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttct

SEQ ID NO: 19197 - DNA, 1247 bp, Homo sapiens
ccctgcgggccctgcctcccacccaccccatcaccagctttccacttggaggccccctgtgccctgcagcctcagggtaggccgtgggtcaccaggctggagagggcccctgccttggccaggggtgcgaggtgacccggctgcattgctgggtgggagctgctgtctgttgttcaggggcctggcccccgccctcccccccgaccccgacctcgcaaagcgcactcccgggcagggtgtggtctggaaggcggggctggcggggacatgggtgttcctgcatctcctagcgcagttcctgctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttggaccagccttgttatttttaaagcaaatgccggcaaactcaaaaaaaaaaaaaaaaaaaaaaaaaaaaaaaaaaaaaaaaaaaaaaaaaaaaaaaaaaaaacaaaaaaaagaggggggggcgcgccctcaaataaaatacccccgcgggggggcgcccaaaatattgggccgaccccgcagtttttttaaaaaaggggtgccccccaataagaggccgttataataacaacgagacatcaggcgcgcatatattaaacacactgttctaccatgggaaaaactgtgtacagcggcggaccatcttgtgaaagaacaccccacacttctggggcggggggagaaacaatatggggggaaccaacacctccccgaaagaaatatattaacgcctccagaagggcaaaataacaacgttgaagagcttaatcagtggttaaaacacacacggtaataatactctggcgccgccgaagacaatattgtgcatcacgaaaataatatatcagagaaacaatttttacag

SEQ ID NO: 19198 - DNA, 1222 bp, Homo sapiens
agcgcaaggtgtggtgagaggagggagcggttaggggaacaataacgagggagagggatgggtgaggagaagaggagtcatgaagcgaatgagaaggaaggataggagagaagaagaaagggggacgggaagaggaagtgatgatgagggagtaggagaccgtgtgagtgagcggaagaaatgtgttggagggatgaaggccacgtgtggagcgactaagacattgggagggtgttaaggaggcaggaggacatgatggggaggagtagagaggggttgagagaggaaagaccagagagggaagaaagtcagtggtctgacgggacaggcaaggtaaagagggtggggataggtaagaggaatggagaatagtgatagagcgagtaaacgaaatgcgcacatgtgaaaaaggagagagatggggtggtggaaggtagcacgagagaagacaagatgggacgaaggttggggaagaggaaccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttggaccagccttgttatttttaaagcaaatgccggcaaactcaaaaaaaaaaaaaaaaaaaaaaaaaaaaaaaaaaaaaaaaaaaaaaaaaaaaaaaaaaaaacaaaaaaaagaggggggggcgcgccctcaaataaaatacccccgcgggggggcgcccaaaatattgggccgaccccgcagtttttttaaaaaaggggtgccccccaataagaggccgttataataacaacgagacatcaggcgcgcatatattaaacacactgttctaccatgggaaaaactgtgtacagcggcggaccatcttgtgaaagaacaccccacacttctggggcggggggagaaacaatatggggggaaccaacacctccccgaaagaaatatattaacgcctccagaagggcaaaataacaacgttgaagagcttaatcagtggttaaaacacacacggtaataatactctggcgccgccgaagacaatattgtgcatcacgaaaataatatatcagagaaacaatttttacag

SEQ ID NO: 19199 - DNA, 315 bp, Homo sapiens
tgtgatcattcctctttgtagcctcaaccgcctggctcaagtggtcctcccatctcagcatgtagctgggactacaggcatgcatgtgccaccatgcctggctaatttttaattttttctgtaaaggcaggctatccctgttcgggctgctcaggctggtctggttttttttgctcagtctggtcttgaactcccagactcaagcgatccaccttggcttcccaaagtgctgggagtacaggtgtgagccactatgcctggtgtgcttgtcaatcttgatgaaattgagagtttttagcactttcacctagcaaa

SEQ ID NO: 19200 - DNA, 652 bp, Homo sapiens
cctgtttgctttaagtactaggggtagaaaactaaccagaaagcatgcatctataaggttagagactgtgtctacctttttcactcctctatacacagcactaagcagaatgcctggcacacagaaagttcaaaaacacttgcaaggtagccctgtcacacaatggatagccttctgaacttccagaaaatacttgcagaattaagtgaatgaatgaatgagcatatcaggaagccagcttaagaagaggctctactctatggtatagcccctgagctggagggcccaattttgtcttaagctcccaaacattacatgaaaccagtttacaccacaacttgctatgtacccatttactctaacataccaccaattagattatgtaccccataataagtagacaagtttttttaaaaataattttagcattctgattatgcccagggaactgtttcttaatgtccaacattttgtcttgctcaaatcactttatctttgagctgggcaaaggcactgttgttatagattgtatataatgaagaaaatgtttacttgcctattagaaacaagactgggaaagaatctaaacatacttcttttctaacaaaaattactttttgaaatgctgaaatgcttttaggaaaaaaaaaaa

SEQ ID NO: 19201 - DNA, 331 bp, Homo sapiens
atgagccactgtgcccagcctcatatggattttcaaaagaacaggggccaggcgtgatggctcacgcctgtaatcccagcactttgggaggccaaggcaggtggatcacctgaggtcaggagttcaagaccagcctggccaacgtggtgaaacctggtctctactaaacaatacaaaaaaaatttagcgaggcatggtggcatgtgcctttccttccagctccaattacatggaaggctgagtcaggagaaccgcttgaacctgtgaggcagaagttgcagtgaaccaatattgagccactgcactctagtctgggcaacagagcgagact

SEQ ID NO: 19202 - DNA, 267 bp, Homo sapiens
ctcttaactacagaagtcctccctatgtttcaagatattatagcatttcattgtgcttaaaaaactagtagcaaataggaagtaacatttgccaaataaaatccataaaaataaagcatcctttacaataaagaaactcttgtcaattatttagactttttaagggcattttgaactcctcaaatacaaatttcacgttcataattgtatcatcaaaatcctatgtggcaaccaaaagctcactagtaggcaggacaccgaattatt

SEQ ID NO: 19203 - DNA, 421 bp, Homo sapiens
ttctcttccccaactttttcttctagtggaaagtgttttgagtggtgatatcagaattcataaacctgggaaagttatgaaatgtgtgtgctggtagttagctttgatagtatatttaatactatatttttgatacttgcgtggataactggacttatctgtgaacatggggtacctacccatcatatataacatcggaaatgagcagtagtgctgctcttagagctggacagggggtatcctggtctaggccctgcgatacatgtgtcttctccagactgctgtctcccctcaggtaaggagtcactgaagccaaggggatgtacccacccagattttgcaacatctcttcctacaacattctgaccctggtttatctgcctacaaaggcctctccaccgagccctatgcagtctcattg

SEQ ID NO: 19204 - DNA, 255 bp, Homo sapiens
tggacaacaaaagatgacaaagggatcgtgctctttataatacattgtgcagttatatacagtttaccactatcccccgacgggtttttcacagaggatacactgtagagtacatacaaaaagctcacctaaagtccacttcaataggaaaacttgccacttaaaaacaatttttatacagagagatgaaagtaaaactttcttctactcatgagaggctaatgaaagtaatgtttagattgtgcgtggtggctt

SEQ ID NO: 19205 - DNA, 469 bp, Homo sapiens
aagccattgctctaaatctctatgctgcacaagatacagctgagtaaagattagtaacaacaaaaaaaaacaacaaaaaaagacaagtcccagggaaggttcctgtgagtctttatgatccactggccataaattagagagaggcaatgaagactaaatgcggagagatccagtttgcttcctagtcttagtacattgccatctaggcatgagtagtctccttgtctccgttgtctgagaatgctatcctctggctctgaggtccagagccactaagagagaatgctgacttgatgtcagaaaatcaagacaaggtctagtttaattatggaacatgaaacaaaaactttactcctcttttgaagtaaaaatgcaaatctgttccgttttagagtgggatttccctcctttgttatatggcttttaaattactcatgttctttacaaatcaaataaataaaagataaaa

SEQ ID NO: 19206 - DNA, 249 bp, Homo sapiens
atttaaatggtgatttttggcaacttgctggaggctgagtgtgtaagaagagtaagaaactcttgaaagccacagtctctagggtaccccacaacttgcataggttttaacaccaggaaccccgccaggttctcaccgtgaagagccagggaagatcctctttggccctttcagggcaaagggaaaagtaatcattgttcaatatcctcaggccgttctccattaataaaggccaacgcaccagagaag

SEQ ID NO: 19207 - DNA, 867 bp, Homo sapiens
gtttcaagtaaatgtctttcgtccttttaatttggtgtgataagaaatattgcctttggtgtaatcagaattatgtagcatgatgcttcttcttggtgctgttatttttactgcagtaaatatttattttagttggcattgttgagttacctcatttgtgagcacagctagtaaagctatggttaaattttattgcttttactcttagaatcactttctcagctagtttaccttggagagacaactttacgttttccaccaaattaaagaagctgagaaaattgggtggaatttttttctttttttttctgtttaaaatgtggttactttgtagtactttggcgaactcactaatgtatgtatgaaagcacacgcttatcaaatggaaaataaaatcaaaacaatgaactccagtatgtttagtaataaagaaaacaaaaaaaaaaacctgtcattttttccaatgcaattaaatacaaagagaccactaatattacatttatctaattcatgtcttctcggcaatatgaaccattcagatgttcctccacctcttttgagagggatgtatgctgtcagactttaccaatgggatacacagttggggttttggaaataattttgaatctccttgcagggtagcctgctaaaagacagggttgtagaaccacttccgagggccttctaaacttaaaaaagaaaaacacctgtagctgtcagcactactttcagcaaacagtccacatcgttatgtgtcatttaactgctttctgcttgtcagcaggagtctttgtttcacacctaagagttgtcacatcagaaatcagaataaaggcctaaggtctctattcccacggggcagtaaca

SEQ ID NO: 19208 - DNA, 270 bp, Homo sapiens
ctctgtttcaaattatgttgttgatcttgttagaaagatagaatatgttctttgtttatgaaaataaataagagactgcctatggataatttttagctgaacccaaagccagacattgctctcaaatgttttcatatacttttatcattaacacagttttggaatctgaatacttaactaagaaatctgattgtgatatctttccaaatatttaatttgtattgctttttgacaaacttttgtatatggttcctgtggacatgaataaag

SEQ ID NO: 19209 - DNA, 485 bp, Homo sapiens
ttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaa

SEQ ID NO: 19210 - DNA, 283 bp, Homo sapiens
ctataacaagcaacaaaaaacaaaataggcaaaagactcacatagatgtttttccaaacacttacaaatggccaacaagcatatgaaaagacacttaacatcactatcattaggaaatgcaaatcaaaaccacaacgaggctgggtgcggtggctcacgccggtaatcccagcactttgggagaccaaggcaggcggatcacctgaggtcaggagttcaagaccagcctggccaacatggtgaaaccccattctactaaaaatacaaaaattagccagccgtg

SEQ ID NO: 19211 - DNA, 350 bp, Homo sapiens
aactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttt

SEQ ID NO: 19212 - DNA, 224 bp, Homo sapiens
gttagaaaacacctctagattctgggaacttgaaacatgtaaccaccctggctggccagaggggcatcaccttgctctcatctttttactcctttaatgctgacctctgccaaattgaatgatatattttcacatcctgacaaaaggaactgaccatagctgatagagccccacacctccttaaagaaaatgttttgtgaaagctaagagatgctacttggggt

SEQ ID NO: 19213 - DNA, 575 bp, Homo sapiens
atttataaacaatgagagaatgagagtctaactggttttctttgagatggactgtttcagcccatggatattaacatttattttagacaggtgttatgcactggtgttgatcttttctgtggtgctattatttaagatagcttgaagcattattgtgaatgtgttgttatatgtattcatttagttgatgctgttgtttgtagtaacataaaacatcaataaggatagtagccaaattgtgccagttagccttcattttctggcattataatgaaactatttaaacgtttgtgattctgtagtatgttaacaaaacatactccgttaataaatttaaaactacattttatagttccatttatcttgcttcgtattacagtttatacatatactaccataaattttctatgatttggttatgaaaaacacagtttatattccaaattttaatatcattttcatatatattcatattctcgtaaacttttaacctgatgaaatatatgcatatttttcctaaagttttaacataaagccacatttttttatattaaatttaagaaaaattttaagca

SEQ ID NO: 19214 - DNA, 404 bp, Homo sapiens
aggctcacctctacaatatcttagctaattattgctatcaaatattaaaccaccgaagatcctcaaataaggtcttttcaatgtcctttacttataacatcgataaaaaaaaaaacacaaaaaacttgattccaggctggggccactgcctgtactgagtttgcatgttgtctcatgtctgcatgggttttgagtacaccagcttttctcccacatctcaaagctgtgcatgttaggtgaattggcatgtctacatggtcctagtctgaatgaatgaatgaatatgtatgtatgaatgcaccccgcgctgggatggcgtactggccagagctggttcacacctggcaccctgagctgccaaggtaggctctggcaaccagcaaccttgaactggaataactggg

SEQ ID NO: 19215 - DNA, 541 bp, Homo sapiens
taggagcaaattacatcaagagatggaattaatgagatttacataaagtcctatcatctgagatgaagttatctagttaaatagtttgctttagggattgaaaagaaaaaatactatctggtgcagggaaatctgttttgggggaccctggttagaaaattcattattgcccccaaatgcattactagtactggagcagacttggatccttttctaccccagagcaatgcttgtcagatgcctgatgggtcataatgttactgaggagcaggccagggtagtcgcccatttttaaaataaaaatacctgttttgttttgttttgttttgtttgtttgtttgtttcttttgacacggagttttgctcttgctgcccagtctggagtgcaatggcaagatctcggctcaccgcaatctctgcctcctgaattcaaatggttcccctgccggctgggcgcggtgaacctgggaggcggagcttgcagtgagccgagattgcgccactgcaatcccgcctgggctaaagagcgggactccgtctc

SEQ ID NO: 19216 - DNA, 1818 bp, Homo sapiens
cttctttctttcttttgacagagtcttgctttgtcacccaggctggaatgcaatggctcgatctcggctcactgcaacctctgcctcccgggttcaagcgattctcttgcctcagcctcccaagtagctgggactacagatgcatgctaccacactcggctaattttttgtatttttagtagagacggggtttcaccgtgttagccaggatggtcttaaactcctgacttcgtgatccgcccacctcggcttcccaaagtgcagggattacaggcgtgagccactgcacctgtccttctgtgtgtatgttatgtttgaaaacaaagtttaaaaaagggaactgctctggttgaagccctgggaggggcagggagatggaaggcaaggagcccatccacagctctgtccttctcctgcaggcagcccttgagggctccttagagtattagcttgaaatccttcatctgtcccaacagagctctgagaaggtcagtgacttgcccaaggttctgcagagccagcactagaactcaggtctcctgactcccaggccagggccctggaggctagtcctttcctgaagggctggtgtcacgagtaaggacaaggggtggctaggcagcctccttcctgatctcagctcccttaacatgagtcttgggaggagggccaagactctggtatgaatgatgcttttctcatcctggagcaacttcctttctgggaattgggtgtctccttctgggcaaagacaataaaattcatccaaagggccagaggagcagggttcctccggcccccacccagatgggcatcacgtggctcccaagttagcagtccaggaaaattccagcccttgcatacttggcctcacacacccatctgctcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgccatgtccctggggctactgaaattccaggcagtgggtgaagaggacgaggaggatgaggagggggagagcctggactctgtgaaggcactgacagccaagctgcagctgcagactcggcggccctcatatctggagtggacagcccaggtccagagccaggcctggcgcagggcccaagccaaacctggaccagggggacctggggacatctgtggtttcgactcaatggactccgcccttgagtggctccgacgggagctgcgggagatgcaggcgcaggacaggcagctggcagggcagctgctgcggctgcgggcccagctgcaccgactgaagatggaccaagcctgtcacctgcaccaggagctgctggatgaggccgagctggagctggagctggagcccggggccggcctagccctggccccgctgctgcggcacctgggcctcacgcgcatgaacatcagcgcccggcgcttcaccctctgctgaggaacacctgtgccccccgactccccgccccctctcccaatgccgcttcccctgcctgcctgggaagaggaaagggaggggtgccccagaggcaccagctcctggcgggggaggaggaacattcaggtttctgagagctgaattccaagagtgcaaaaccccagcatcctgtttcctctgctgacccagctgggagggggaggaggaggagctcacaccctcaaactcctcaataaacgctttctctggttcccaaaaaaaactct

SEQ ID NO: 19217 - DNA, 975 bp, Homo sapiens
aacgaaagatgtacgagcgtcggcactcggttttgtatttcaatgcacgggacggcgttttaattgtatatactgtgccgttggctttacaaattcacacactccctggcacgctcttctcaccctcaacttctgccacctctccctgggcaatactgccagcctttccctaatctcagagctgcagccctgccctgtcactcacctcaaacctgccatgtccctggggctactgaaattccaggcagtgggtgaagaggacgaggaggatgaggagggggagagcctggactctgtgaaggcactgacagccaagctgcagctgcagactcggcggccctcatatctggagtggacagcccaggtccagagccaggcctggcgcagggcccaagccaaacctggaccagggggacctggggacatctgtggtttcgactcaatggactccgcccttgagtggctccgacgggagctgcgggagatgcaggcgcaggacaggcagctggcagggcagctgctgcggctgcgggcccagctgcaccgactgaagatggaccaagcctgtcacctgcaccaggagctgctggatgaggccgagctggagctggagctggagcccggggccggcctagccctggccccgctgctgcggcacctgggcctcacgcgcatgaacatcagcgcccggcgcttcaccctctgctgaggaacacctgtgccccccgactccccgccccctctcccaatgccgcttcccctgcctgcctgggaagaggaaagggaggggtgccccagaggcaccagctcctggcgggggaggaggaacattcaggtttctgagagctgaattccaagagtgcaaaaccccagcatcctgtttcctctgctgacccagctgggagggggaggaggaggagctcacaccctcaaactcctcaataaacgctttctctggttcccaaaaaaaactct

SEQ ID NO: 19218 - DNA, 473 bp, Homo sapiens
agggaccctgtgcaggcctaggcctactatcttgttcttcccctgggcacccgtaggaaatagtcacatataatactcagcaaactatccgtttcttaaaacactaaaaccccagtgatttcaattaagtgggaataaaggtcagaatgaaaacagtgagaaaaaattttttaatccagttgtattgtacaactataaaccatgtattgtccttagtacaggttctctggagacctattctttgaataaggatgacaatgtattatttcaacctgaaacgggctttcaatcccaggaaatcttttttgctcctcactaatttgctccccaccaagtctactgccaactcctcacactgtcctcaagctatacacccctccccttctccccagtcccaacgattctcctttagatgatgtcatttctcaaggccaagaaaatgacacttcctcaattttgctcatcttactcat

SEQ ID NO: 19219 - DNA, 573 bp, Homo sapiens
acagcataaactattgtgtctttgctattgtgaagagtgctgcaatgaacaaaaatgtgcatgtatctttataataaaatggtttatattcctttgggtatatacccagtaatgggattgctgggacaaatagtatttctagttctagatctttgagaaatagtcacatataatactcagcaaactatccgtttcttaaaacactaaaaccccagtgatttcaattaagtgggaataaaggtcagaatgaaaacagtgagaaaaaattttttaatccagttgtattgtacaactataaaccatgtattgtccttagtacaggttctctggagacctattctttgaataaggatgacaatgtattatttcaacctgaaacgggctttcaatcccaggaaatcttttttgctcctcactaatttgctccccaccaagtctactgccaactcctcacactgtcctcaagctatacacccctccccttctccccagtcccaacgattctcctttagatgatgtcatttctcaaggccaagaaaatgacacttcctcaattttgctcatcttactcat

SEQ ID NO: 19220 - DNA, 3393 bp, Homo sapiens
cgcccgggggaggctccagttggctctacgaccgccgttgccgctgccagagagggccaggcagggcagggacgcgcagcatcggggcgggcgtggggccggagaaaagggtgtcggggccacacacgcaccctcgctgcagtccagctcctcccgaagctcgcacgcccagagcgcacggagcgggggactgcccgcccagacgcccgcccgccaacccgcccacgagccggggccaaagcctgggagcctgcgaggggaggaggcccaggggggcggggtggggggcgggggtgggtgccgcgctgccgcggagctgctactcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgaccagcgggaatacgacgaccagagagcgctggagattcacacagccaaggatttcatcttttccatgctgggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagcttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgttcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttgaaattttgttg

SEQ ID NO: 19221 - DNA, 446 bp, Homo sapiens
agcgatttctcatgagacctggttgtttgaaaatgtgtagcacctccctgccccttcactctctttccccttctctggccacgtaagatgtgcctgcttccctttttcttacaccatgattgtaagtttcctgaggcctccgcagccattcttcttgtacagcccttgaccatgagtcaattaaattcttttctttataaattgtctagtctcgggcagttctttatagcagcagaagaatgacctgatatatatggttcactccattatgggttccaccaatttttttctgttatgtgggttagcaacatgcttatgtattttttttctgcattttaacaaacttttttcattaattcaattaaaagcattgaattggtatattgtctaaagtttaaggcatttttaatctccttttttgcaataaattcagttttatacctgga

SEQ ID NO: 19222 - DNA, 236 bp, Homo sapiens
tggttttcataggggactattttgagatggacttctaaaactgtgtgtaattttaagagtaattagaggtaatctcaacgaataaaacatctcacaaaagatgaatcaaaatcacacctgcctcgccacaccagtcatgggctcctggaaggcagggattcttttggattatcctgacactcctactacccagaaaatatctgacacaatgtaggcatctggttaaaatgtgctaa

SEQ ID NO: 19223 - DNA, 360 bp, Homo sapiens
aacagacaatataagaaataaaaatttctaaaaaactaattatttagaaagatgaaaaaatataaccatgaatttctatcaatacaaaggtaagaactaataaataagagttattaggcttaaaattagtgtggcagaatttaaaatgagtaaaatatttggaaggtaacattaagaaaatcttctccaaaacggaaccaaaaaacccacaataaaacaaatgtatggaaataagaataataaaattatcaaacctagatatcaaacattcaactaatacaatttctaagaaaaaagaacagagaaaacataggagaggaaactattaaagaaacagcaaagcgaatattccggaactga

SEQ ID NO: 19224 - DNA, 227 bp, Homo sapiens
tctctgcacattacccagcttccccgccatgttaaaaagacaacagggaggactacaaaattccctatttaacctggcaaaggctgtaaggggctctgggccggataatgcccttgaatcctaaagtctttcttaattcctctcttgagccaaaatttggagcattgccatttcgtatcccattcagaatgtttttgtagtgaatataaacttattttcctgttaac

SEQ ID NO: 19225 - DNA, 164 bp, Homo sapiens
taaaggaatatgggatacattaaaaagttcattcgaaaaggttatataacaggaggagctttttccctcagaggtaaaaacattgtttgtcttaaagaattcagttatttatgagactttattattctctgatgatgccagatacagttaggtaacttccttgt

SEQ ID NO: 19226 - DNA, 730 bp, Homo sapiens
tggtagagacgaggccttgctatgttgcccaggctggtcttcaactcctgggctcaagtgatctgcccaccctgcctgagcctcccaaagtgctgggattacaggtgtgagccactgtgcccactatactttttatttttttatttttatttttttttcaaatatttttcatccatggatgcagtttcacatctatggagggctgactagcattcaagagcttttggtttaaaagatcaaaacatcccagcagtgttgatcagtgacaattctattaccatataaggtttcccaaatccttacccagcttagttctcttgggaagctcttaattgttcctattttctaggaagttatcaaagataacaatctcatatggaattaccaaccccctgtgtaagaatgagattttcattacctcactggtgaatcagaaaaagtatctcactattacattggtttccattctgagtcataggcctaaagtattaataaaaaagcctagagtttgaataaactgcactatcatgagcttaccaaaatcaatgacttaggatttcctgtcttttatttaaagctttaccaagttaaatgtggaatggaaactggtgacactttgcccaggaatgtcagggaggttaacttatgtctcaatttttttcatgcacagtcccaggagctactaccatgcattattttattattaccatggagctatcaccaggcatta

SEQ ID NO: 19227 - DNA, 463 bp, Homo sapiens
tggtagagacgaggccttgctatgttgcccaggctggtcttcaactcctgggctcaagtgatctgcccaccctgcctgagcctcccaaagtgctgggattacaggtgtgagccactgtgcccactatactttttatttttttatttttatttttttttcaaatatttttcatccatggatgcagtttcacatctatggagggctgactagcattcaagagcttttggtttaaaagatcaaaacatcccagcagtgttgatcagtgacaattctattaccatataaggtttcccaaatccttacccagcttagttctcttgggaagctcttaattgttcctattttctaggaagttatcaaagataacaatctcatatggaattaccaaccccctgtgtaagaatgagaggctgagaaggcggcggctgaggagaaggcggccggcgtgaggagaaagcggccc

SEQ ID NO: 19228 - DNA, 183 bp, Homo sapiens
gtagaactaagttttttatgtgagtactttgccctactgtctatatgatgacatcttttttgagcagctaaattttaaattgtatatactttattttgtgaatccttgttgaatgtgctaaaggtttctttgtgtagttcttccatgctatgcgaatattttagtaaaagtagttgattttta

SEQ ID NO: 19229 - DNA, 456 bp, Homo sapiens
cctactaaagttagatgggtagagccatggtgatacttcatttaccacctctgtaatctaagaacagaagctatcacatgtctatgacatgtcagacactgctagcatgttcttacaagggaggttattattctcatttccagagaagcatccagtcctcaggactaagtactcttaatgtctgttggtttatctgttctttgaatagatcttttgtccatgcatgattttacattgtcatgttaactaccggtttactgagttatgaagatcttccaaatgttgacacatttcattgttcaatatccagaagccgccataattaatatcagcatcaatctctgtggaaaagtcttggagtgctctcagtcaagtacaagcttcccaaaattctaattttcacttgaaatcttagatattgttgttgacaataaacgctgtcagttgtttgccttg

SEQ ID NO: 19230 - DNA, 769 bp, Homo sapiens
ggcttctagttgcagtaggagggacgaattgagagcaagggtttaaggactaaatgcagggtgcagtacagtgtcagtgtcagtgtgcagtgctcaggaaatatttgttgaaggggaagagtatgcttcttcagtccaaggtggaagcatgaaggaaactgtaagcacattgatctagaccacagtttcaggtacagaggggagcgttaactaaagctcagagcggggaaagcacagggtgcttacaaaatggcaaatgctgtcatttaggccagaatcctactcacactgctgctgtatatcctcttcatctgtgtttaggattttgaaatgcatttttgttggattattgccccactagaaaaaacagttcagatctgttgcagtttcacatttgaaactactttcattctggaatccttatccttagaccttcctaataatttctgtggtcacactggacctgatctcttcctgtgctaaacaaaagcacacaatcacaaaactgtgtaggcataaatgagaggcatatgggagtggtgtaaaaggaactggaagagtcttaatatgcctgggtgggcgagctaaactaatagctcccagcagtttttctgaatcagacattgtggagccaggagtctagcatttggaattccactgcctgtgcaaagggtctgtcttttatcctccaaaccaccatttgttaactggttaatgacccagtggacccgttgacaacaaaggagggaaagctggtaaagatcaagtt

SEQ ID NO: 19231 - DNA, 159 bp, Homo sapiens
tacatggcaaaccaatccaagagatggtgaccgatgggtccataaagactctggctggcaatgctgtcagcttccttcagctgagcgtcagttagttaccctggtagtctcaaatgtctccttgtgtctggagacaacatagggcctggccctgaggac

SEQ ID NO: 19232 - DNA, 271 bp, Homo sapiens
gaagtctgttgaaatgatctgaacccttcaaaaaatattggtaattcattgtggctatatttatttttattagtttctctatgttgcctgttttattgactttccacagcaaaccaccacccccaccagcaccaccaaataccgttgtattttgattccttatgttctttattagcaggcttacttctctcttcatagaactatgcctttgccccactgctccatttcagagcattcggggctattcctggtaagaagccagcattagtta

SEQ ID NO: 19233 - DNA, 524 bp, Homo sapiens
gggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagcc

SEQ ID NO: 19234 - DNA, 909 bp, Homo sapiens
aacttgttcttcaaaagccctatttggggagaagtgtgctccttctctaaaaccgctgggtggcgctagtgcgaccaaaatcttctcccccgctatgaaaagaaaacctgaccaccaacaaaacaaaaaagacgaaacaaaaatggcgacaataaaaacaacatgccccccccggattacagggaaaaccagttacagggaggactaccacctattaaaagtatttttctggaaacagctggcgattaccctccaaaagtttaattaccattattgaaaacgcgtattggaactgccttggataatcttgggaagagggaaagaaaataaagccccaaggtaaaaaatacttttaagacgtggacagaaaaatataggatcacgtaatattttgatggtaactgacttatttagatttatgtattcacaagtttacctctgagtttatttgcataccatagtttactgggtgttcctatttaaatctatttgttctcatattttcaaattgagtcatacttgctgattaaaataaacttaaggacatcattattccttattaaattaccagaggagtgctttttaatatgcctaggttttgtatgtttaaaatactgtacctaatgcattcccacatcgctattgataaggattttcgcttgttgatgattttaaaaggagctcagaggtcttccagagatttaattctgacgcagtcatctcgaccccaccattcaattaagacccctagcgaaagtactttcttacatgttaaagctgagaattaggaaatacaatagcattaagagaaaataagtagaatttgattttcgaattttaaattattcaagactactcacggaatctcaaagccaggcgttgaaatcatcggcagcaacatcagcatgt

SEQ ID NO: 19235 - DNA, 479 bp, Homo sapiens
gaaagagcctcccagctcttagagtttgattttcgcaactcagttcacatcttcttcttactccaggttcccagctccttgagccttgcccgtgaaggggttggagtcaggatgggaagccttgagctgccttgacctgctccatctctgactcagggatgtgccctgcttgtcacagcatgggtgtgctgggccttggggcatcttttcaggcagagagcaagacgttggcattgtggaaagctgtacctccaaacagcagcccattcacagactacagaggaagaaaagaccacacttgctacagtaacaatgcaattcagtaccagggaataacttaacatgaaacatgtcaaatctatgtaaacaactggaaggcactcctaaaaaatacaaaaaagaatttgaaaaaaaaaatcatgttctaaattagggaagtttgaggttctaaatatatcaattcttcctaagttaattta

SEQ ID NO: 19236 - DNA, 922 bp, Homo sapiens
gtccatcttgctgctgtccactttgggttccatcttgggctccatcttgctctcacgattaaaagcttctttcctgctttccccattccgaccatcatttgcaccccggttctccccatgccggcctgcgcttcctccatgtctgttctccccgtgccgatggccatcagtatgacggctgctgctttctggatggcggtatccatctccatggcgaccaccatctccgtgacgtggactatcgctatgccgattgccagtctctccgtgactgtgacggctgctgccccggttctcagtatatctctctcttttcccgttgctgcccccagtcccttctcggctgttattccctgaagctgtgttgttgactccttgggctccggcagacgggtaggtcacaggggcaccactgatgttgccagtattgccaaagcctgggatgcccttggcggcactggtgacggggctgtcaggactgttatggccctgttgtgctgagttagttggaacagaattcaagctccctgcactagccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 19237 - DNA, 652 bp, Homo sapiens
ggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggcccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 19238 - DNA, 477 bp, Homo sapiens
gcggccgcctactactactaaattcgcggccgcgtcgacacccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgaaaaaaaaaaagtcgacgcggccgcgaatttagtagtagtaggcggccgct

SEQ ID NO: 19239 - DNA, 2089 bp, Homo sapiens
ggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggcccctcccctgactatcaaagcagcggccggctgttggggtccaccacgccttccacctgccccactgcttcttcgcttctctcttggaaagtccagtctctcctcggcttgcaatggaccccaactgctcctgcgccgctggtaaggaacgccgggttccgtgcctggggatgctcgattcccagacaccatagagagtgttcctgggtttgagaaggtcgtattttgagatctcaactgtaggggactccttgacttagtccagtgctttcctcttggccaagatcctgagagcatttccttcctctctgtgcctctgtgtcagcgttgagggtactgaggctcaaggctgtcctgctccacgtcatgcggtttgtcccagggctgttggctgagccccagtgctctgaccaggctttgagcagcaggattagataggaggcaggggacattgcctcttcggggttcaggacagaaagtcgaagtcgccgtcttcccaggctgtgcctggagcctgggactttccctttggagtgcaaacaggaggctgcttggccttcccagcatgaagggagaggacatggggcttctcttcctctgctctgagtgggaaaggagctctgagggctggccccgcacagaggagggggcaatggagactcattaactcactgctgtacctcctgcaggtcactcgccgctcactggctttttttttctctttctcgcaggtgtctcctgcacctgcgctggttcctgcaagtgcaaagagtgcaaatgcacctcctgcaagaagagtgagtgtgaggccatctccatggtctggggctgtggctaaggttgggatggaacccaaggctggccctgagtgcatgcttctggggaactggccttcctttgtccccgtaggttgtcactgcctttctagtcttctgccctgtgcaagggcgcctgggcagctttctcataggaagacccaccccagatatttcccagttgtctcctgacaaagccataccctcctgaactgagggtcctttgtggctggaggctctgttgggggcctctgttggggagggaggtccctgggcaagttggctgtgacctctcatgctcctcttcttccccaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatggcagcaaagtgactggagatgtggaggaaagcgtcatctcagcaacgcagagtcatgagaaggactgggtgcagatgaaggatgttgagtgtgctgatgcagtggtgatggcatattctgcagttggaaggtgtgttgctgttcaagaaggagagaggagtcaccctggtgactggtagttaggccaacagtaggttccactggctactggttcgagaattgctatctgatgttcaatcacagaggaagaggagttaagtggcccaggagtcaggaccatgcttgcccgcaggtgccctttgtgaagagggcatttcagaaggcagcgtgggtcatgtgcaagtttgggtgtcacataaccagattcacagcccacttcacaccttcctggctgtgtagctggcacaagtcacttaacctctctgtgcctccatttcctcacttgtagaaagcagattataaatatatgtagggattaaatgtgatagtgccctggtacctggctcgggcttaataaacagtgctgttataatcatttgtcca

SEQ ID NO: 19240 - DNA, 1242 bp, Homo sapiens
ggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggcccctcccctgactatcaaagcagcggccggctgttggggtccaccacgccttccacctgccccactgcttcttcgcttctctcttggaaagtccagtctctcctcggcttgcaatggaccccaactgctcctgcgccgctggtaaggaacgccgggttccgtgcctggggatgctcgattcccagacaccatagagagtgttcctgggtttgagaaggtcgtattttgagatctcaactgtaggggactccttgacttagtccagtgctttcctcttggccaagatcctgagagcatttccttcctctctgtgcctctgtgtcagcgttgagggtactgaggctcaaggctgtcctgctccacgtcatgcggtttgtcccagggctgttggctgagccccagtgctctgaccaggctttgagcagcaggattagataggaggcaggggacattgcctcttcggggttcaggacagaaagtcgaagtcgccgtcttcccaggctgtgcctggagcctgggactttccctttggagtgcaaacaggaggctgcttggccttcccagcatgaagggagaggacatggggcttctcttcctctgctctgagtgggaaaggagctctgagggctggccccgcacagaggagggggcaatggagactcattaactcactgctgtacctcctgcaggtcactcgccgctcactggctttttttttctctttctcgcaggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 19241 - DNA, 964 bp, Homo sapiens
gtccatcttgctgctgtccactttgggttccatcttgggctccatcttgctctcacgattaaaagcttctttcctgctttccccattccgaccatcatttgcaccccggttctccccatgccggcctgcgcttcctccatgtctgttctccccgtgccgatggccatcagtatgacggctgctgctttctggatggcggtatccatctccatggcgaccaccatctccgtgacgtggactatcgctatgccgattgccagtctctccgtgactgtgacggctgctgccccggttctcagtatatctctctcttttcccgttgctgcccccagtcccttctcggctgttattccctgaagctgtgttgttgactccttgggctccggcagacgggtaggtcacaggggcaccactgatgttgccagtattgccaaagcctgggatgcccttggcggcactggtgacggggctgtcaggactgttatggccctgttgtgctgagttagttggaacagaattcaagctccctgcactagccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagtgagtgtgaggccatctccatggtctggggctgtggctaaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 19242 - DNA, 427 bp, Homo sapiens
gcggccgcctactactactaaattcgcggccgcgtcgacacccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 19243 - DNA, 849 bp, Homo sapiens
ggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggcccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgaaaaaaaaaaaaaaaaaaaaaaaaaaaaacaatgtgtgtgtgcggcgcgcccatgcggcccctggaagaagagtctttcgaaagaaccacactgcgtggggagccccgggggcccccggtaggtgttcgcgtggaccacggtggcccaacaggcgggttcccagaggaaaaaccgcggggccaggaaccaagggccgg

SEQ ID NO: 19244 - DNA, 2052 bp, Homo sapiens
ggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggcccctcccctgactatcaaagcagcggccggctgttggggtccaccacgccttccacctgccccactgcttcttcgcttctctcttggaaagtccagtctctcctcggcttgcaatggaccccaactgctcctgcgccgctggtaaggaacgccgggttccgtgcctggggatgctcgattcccagacaccatagagagtgttcctgggtttgagaaggtcgtattttgagatctcaactgtaggggactccttgacttagtccagtgctttcctcttggccaagatcctgagagcatttccttcctctctgtgcctctgtgtcagcgttgagggtactgaggctcaaggctgtcctgctccacgtcatgcggtttgtcccagggctgttggctgagccccagtgctctgaccaggctttgagcagcaggattagataggaggcaggggacattgcctcttcggggttcaggacagaaagtcgaagtcgccgtcttcccaggctgtgcctggagcctgggactttccctttggagtgcaaacaggaggctgcttggccttcccagcatgaagggagaggacatggggcttctcttcctctgctctgagtgggaaaggagctctgagggctggccccgcacagaggagggggcaatggagactcattaactcactgctgtacctcctgcaggtcactcgccgctcactggctttttttttctctttctcgcaggtgtctcctgcacctgcgctggttcctgcaagtgcaaagagtgcaaatgcacctcctgcaagaagagtgagtgtgaggccatctccatggtctggggctgtggctaaggttgggatggaacccaaggctggccctgagtgcatgcttctggggaactggccttcctttgtccccgtaggttgtcactgcctttctagtcttctgccctgtgcaagggcgcctgggcagctttctcataggaagacccaccccagatatttcccagttgtctcctgacaaagccataccctcctgaactgagggtcctttgtggctggaggctctgttgggggcctctgttggggagggaggtccctgggcaagttggctgtgacctctcatgctcctcttcttccccaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgagattctgacttcagtttcccttatgtgcttcagaaatcagagactggggtgggggatcgaactagggttgcagactcctgggctctaaatggaaatctgagtccctaacaatcagagtgcattaaggcaagccaggctgcctcactgtgcttcctcttctgtagaatggaataacacttcatcaggtcattggtggggatccagaatacaggatcaccttcattctcaaatgtggcacagaaacttctcaatgcctcctgttccttctctgatttctctgcccaacttcaattcctctttggatttcaggttagaaagtgactacacggaatggaatcaaaccccttagttatttgaattctacaccgggcttctcaaactccagggtgaaggaggggtttttaattcctatccattccacatctaaaccttggtaaatgaaataatactaatgatggaagtcatgaaattaaattc

SEQ ID NO: 19245 - DNA, 291 bp, Homo sapiens
agggagccacttctttaccgctagctcctgcaggatctgtgggatcctgcaggtgctggtttgcctcctgagccctgtcctaaggacactctgcacatcgcctcctggtgagtgagctgggggacttcttctggatacatctgaatcacttcattcgcacctcaaggctctctgggaggaaagctggtgcaggaactagtgtcttaggattatgagggaggacgtggaggcagaggtgaggacggagctaaagccaagctgcagggagcctttgggcaggaagcggagctt

SEQ ID NO: 19246 - DNA, 505 bp, Homo sapiens
tgctcccttactgccagtttcctatttattagatgacacatttcaacaaaaaactcagattaaaaaatggtcaacatttgctgtgactatggctagaaagaaggaataaataggataccaggataaacaagaatttccctagcttctcattcactctctcataacctcccacccaaaagtctatcttaaatatagtttcagagtatggagaggactgaggaatgcagaatgaaatgacaggttaatattagaaatgccattgtgggagactctcaggaatgatttcaaccttcacctgcagtttcacttaaatcacaccaggtatagaatcattgtgactcagtggtttatgcaacaatctggaaactcaggacctgtaagctttggccatgtgtctgacatttgttttccacaagtaagctaatcatgttcactcactgtgcttcatttagcttttatctattaatgaagaaaatgatatgaaattacttcccagggttgtaaa

SEQ ID NO: 19247 - DNA, 416 bp, Homo sapiens
cctgtttctggcgtggccttccctgggagcgagttagggacacggaagctcacccgcttctgaatgggtccactcctggggatttccgcggccttccctgggagcgggttagggacacggaagctcacccccttctgaatgggtccactcctggggatttccgcggccttccctgggagcgggttagggacatggaagctcaccctcttctgaatgggtccactcctggggatttccacggcctttcctgggagcaggttagggacatggaagctcacgcccttctgaatgggtccactcccggggatttccatggccttccctggatgatccactcctggggattttccgcagctctccagatgacgtgcacgcacactaaacacccagaagttagggaggcactgatccagtga

SEQ ID NO: 19248 - DNA, 1712 bp, Homo sapiens
aggttcggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacagggtaaaatcaaatatttaggattgttgtatcagtgtagggtttattttcctatctggttttcttgggacacaaggaattatgtttaaaacttgtcatttttatacttcctatctaaatacctacctctttgctgatccattatttagggatgtataatgataaggataggctctgaagacagtatacctagatccaaatcctggttctaccacttattaactgtggaccccaggcaaattgcctaacttacctgtgtttcagaatctttgtctataggctggtgataaaaaataatatcacttacttcaaaggattattgcaaaattaatacagaaaaaaagtaccctggacatataatcactcaatagatacggtttattactttgaatattttcttctctttaaatagacttgctttttaataggagtagcctgatcctaagcagtatatctgtaaaattatgggcttgatataacagccccttttagtctttttgtgctgctgtaacaaaataccacagactgggtaattcacaaacaatagaaatttatttcccatagttctggcggctgggaagcccaagataaggtgccaacaggattgctgactgggaaggctgttgtttgctttcaagatggtgccttattgctgcatcctttggatgggataaatgcagtgtcctcacatggaagaagggatggaagggcaggagagtgctcccttcaaccttgagcacttttctaagggtgctaagggctctactgtcatgactttatcacctcccaaggccatccctcttaatagtgttgcactggagattaagtttcaacatgaattttggagggaatactatcattcaaagcataacctggccatatatttttaaaaatttacattaaaatgaatatgtaattcttaaaataaagcaaagtttatctctgtatgaacatggaccataccaaagcacagagatgaacttatttggtctccatagttgtggattttacagtcatatggtgggcactgaggacctaaagacaatagcttagatcagaaatccctgcccttgaggtataccagtctaatggggctgataaacatgtc

SEQ ID NO: 19249 - DNA, 479 bp, Homo sapiens
tgaaaacagttaggaaattctattctccgaagggttcgttcctttcttgatgtgtcacttatcattatttttaattccttctagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19250 - DNA, 679 bp, Homo sapiens
gcagactttaatttttaatgtgacctgcatttttaaaagcaaacgccttggcgctagtctaaaaggctgccttttatgtgtcaaaatctggaaaataaagaaatcacaccgaactgtataggaaattatatggatccctgccccataaagtagcaatttgttttcactgcctttgtttagcttcccccaaattccgtagattctggttgattgaaacctgttttcattcattcattccctatcatttactgaaccctgatagtgtactgattattggggcagggacagggttgactaagacagtccctgcttggcatgtcctgacccagggctcagttacttgtcttctccacaagattctggggtctggaaagatggggtaagtgtcttttttctttctgaccacagctcctaggacagcacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19251 - DNA, 1989 bp, Homo sapiens
aggttcggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19252 - DNA, 1633 bp, Homo sapiens
ttctcgcgcggcgctcgcgatccgaaaacatctccacttcctcctcaccccgcgcagtcgggacacgggcgtccagacgccggccccgagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19253 - DNA, 1941 bp, Homo sapiens
aggttcggggcggggcgcgctacccgcagtccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggagtcagagaatgaaagcaagtcaagcaaattacttctcacaactaataatagtgggctggaaaaaacggaagcgattaccttggtgaataaatgtgccatgcctgctgtctagcacctgaaatattatttaccctaatgcctttgtattagaggaatcttattgtttgtatgtctttttaataaattttgtaagaaaattttaaagcaaatatgttataaaagaaataaaaactaagatgaaaattctcagtttta

SEQ ID NO: 19254 - DNA, 870 bp, Homo sapiens
gcagactttaatttttaatgtgacctgcatttttaaaagcaaacgccttggcgctagtctaaaaggctgccttttatgtgtcaaaatctggaaaataaagaaatcacaccgaactgtataggaaattatatggatccctgccccataaagtagcaatttgttttcactgcctttgtttagcttcccccaaattccgtagattctggttgattgaaacctgttttcattcattcattccctatcatttactgaaccctgatagtgtactgattattggggcagggacagggttgactaagacagtccctgcttggcatgtcctgacccagggctcagttacttgtcttctccacaagattctggggtctggaaagatggggtaagtgtcttttttctttctgaccacagctcctaggacagcaccttcaggagtaatgatgcaggcagtagctggcaattaaggaggcgctccatgttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19255 - DNA, 297 bp, Homo sapiens
ccatggacaaggtcgggaggagaacagtcctggcctactctcttttctgcagtgcactggcctgtggtgtcgttatggtgatcccccaggtgagttatcttctgttttttataagacagttatactgtgacagtttgatgggaagaatttagcttattacagttaagtatgaaggtcaattcagagtatgatttgggcagagtatataatatttaaaaatctgttttctttaaaacattctttttctgttatataagtaatatatgttcattttagaaaatttgaagagaaaaatgt

SEQ ID NO: 19256 - DNA, 768 bp, Homo sapiens
ttctcgcgcggcgctcgcgatccgaaaacatctccacttcctcctcaccccgcgcagtcgggacacgggcgtccagacgccggccccgagctgggcttctcctctaggcctctggcagcgggacctggcatggtgagcagaggcgctgggctcgctcggagtgcgcctgttgccgggcaggagggacctgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacagcaggctaggacgccggagtggacttgtgggccaccaagcaggaggcaatgattcaggtacggaaataccaccggcggctggcccccgactcatcaccc

SEQ ID NO: 19257 - DNA, 1995 bp, Homo sapiens
ttctcgcgcggcgctcgcgatccgaaaacatctccacttcctcctcaccccgcgcagtcgggacacgggcgtccagacgccggccccgagctgggcttctcctctaggcctctggcagcgggacctggcatgattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagtttta

SEQ ID NO: 19258 - DNA, 2836 bp, Homo sapiens
gggcctcgcgggaccggaagtgccggatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19259 - DNA, 2757 bp, Homo sapiens
acgctgtcggacgcgccgagcttgtcttccctgatacctgggcgatctgcagcctctcctccctagacccccgttgatttccctgatccatgatcaccagtttctccacgggagtaaaaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19260 - DNA, 1927 bp, Homo sapiens
gggcctcgcgggaccggaagtgccggatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaccacagtcaccatgataatggcagggatcctctagacacc

SEQ ID NO: 19261 - DNA, 2508 bp, Homo sapiens
gggcctcgcgggaccggaagtgccggatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggaggtacgagggaaattgcctatcagtggtcagcagccatcttttcccatgttgagatagagccctatacaaacatcatggtgaagacacttatcttggtgacattgagccacacttgaggggattctttggtgactgacatgatagcaaggcatccttggaccagggagaaaagctcaggagttggaagatcagaattcaaattagatcttccaggcaaggcacggtggcacattcctgtaatcccagcactttcggaggccaaggcgggtggatcacttgaggtcaggagttcgagaccagcctggccaacatggcgaaaccccatctctactaaaaatacaaaaattagctgggcatggtggcagacacctgtaatcccagctgcttgggaaactgaggcaggagaatcacttgaacccgggaggcagaggttgcagtgagctgagatcgtgccactgcactccagcctgggcgacagagcagactctatctcaaaataacacacaaattagatcttccagcacatagttggcgtgtgaccttggacaagtcccttagccctctgagcctcagtcctctcatctacgaaatgagatgcatagctccatccagccctagcttgtgtttcttgggtagcctaatgaaaaaacaggattgaggccaagtggctcatacctgtaagcttaacattttgggaggccaaggcaggaggattacttgaggccaggagtttgagaccagcctgggcaatgtggtgagacctcatctctac

SEQ ID NO: 19262 - DNA, 2236 bp, Homo sapiens
  misc_feature (164)..(164): n is a, c, g, or t
  misc_feature (224)..(225): n is a, c, g, or t
actcgcagggagctcactactcgcagggagctcactactcgcaggagctcacttctgtgtaataagctgcggatgggctttcctgccaccaccttccaggacatccagcgcggggtgacaagtgccgtgaacatcatgcacagcagcctccagcaaggcaaatntgacacaaaaggcatcgagagtactgacgaggcgaagatgtccttcctggtgactctgannaacgtggaagtctgcagtgaaaacatctccactctgaagaagacactggagagtgactgcaccaagctcttcagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19263 - DNA, 2260 bp, Homo sapiens
gcgggcggatcacgaggtcaggagatcgagaccatcctcgctaatacagtgaaaccccgtctctactaaaaatacaaaaaattagccgggcatggtggtgggcacctgtagtcccagctactcaggaggctgaggcaggagaaatggcgtgaacccaggaggcggagcttgcagggagctgagatcgagccactgcactccagcctgggcaacagagcaagactccatctcaaaaaaaaaagtaaagaaaagaagacacatctcccaaccttttatttaggtctggcagaattttagggagtgaatgatttaggtgaagcaggtaaatggaaaatgtgattgacagctatctctgattctaattgggccagcagagctaggagggccatctggcagagcttttccttatgggcccagtggggagggggaatttgggactctctttgccctgtagctcttgtgtctaaggtaatccattgtcgtcctattccttctgctccatgtgtctcagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19264 - DNA, 2447 bp, Homo sapiens
acactggcctgcatcttgcccattgacagcttactttggacttgaggtgttgtcgagatgatgatggcctcagttcaagaccaaaacggaaataaaaagagcttcctgaaaagaacacagcagaagtagtaaaccagttctctatcacaaaatgtgcaacagtgccctctaatgatataatgacaattctatttcttgaggtcctattaagtgtccaagtaattgtctccaatttccccttcattcctaagatgttaaagataacgtttgctttttcagaactttgttttttccttcttttgagcagagaaagtaaaagtacgacatagaaataggagtggcctcatacaattgtatttctagaactccagactaggagactataaacagtagtctattggaacaccattagcatgacttttaagcacagtaatagaggtgagtattattagcatccaacccaaaaacaaatctttggcctgtcatcctgaaagcccactgctggcttgaagggaaggtaaacctggtaaacaaactaaatctaaatgttcttgtatgccaaaagtttggagtgaccagcaagaggccaatagatgtgggggtggggaagaatattctcattcctgtggtatgttgcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19265 - DNA, 1673 bp, Homo sapiens
ttgtggtctttgctctttatttgtctttgctttacctcctcagaggaaataaagcatgagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19266 - DNA, 1549 bp, Homo sapiens
tagctagtagagccgggtcaaatcggccgagggagggcgactgtccatataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagag

SEQ ID NO: 19267 - DNA, 375 bp, Homo sapiens
gctcctgtgatagcctgggctggccatcctaggcttgttcctgggcaaagtcttgcttgctagagaaatatcatcccctgagaatgaggatagctttaggatatgtgcacactgttcctaattcctacccatttgagcaactctaagacaaggagtgatcctttgttgtgacacaaacaatcccaaggaattttgttgctctctttaggccaaagattgtgtgtaataaatttctggagaaaacacactgttaaggctgggcatggagctcatgcctgtgatcccagcactttgggaggccaaggctggaggattgcttgagcccaggagttcaagaccagcctaagcaatatagtgagaccccctatgtctaca

SEQ ID NO: 19268 - DNA, 653 bp, Homo sapiens
atcctcaaggccagccccactcctgctgaccccccttctctgcaaccctgcgcggacactccggttggctctccatcctccactgcctcactcagcggttacctaacctctccaggtgtttgtcccggctcgcgccttactcattcctccaggtccctctccagtcaccagcgacgcttgtcagttctcactaaatatcccgggccgaacaaagtaaactggacccgataaagcacctccaaggagtaaaaggagcagagcctcacactcgacacggaatcccgtcgtggttccaacaacccgagccaccccagggccgggccctggatggacttgtgcacagagctccccccacgagcgcgtgggaccctggggtgcccgcggccttccacgccggcagaacagcagggctcgatggtgggggatgttcggagcgaccagaagccgcgccgcgccacccggccggcctccgagctgtttgcgatttcctctcggggctcctcgtcctcctccccctcaggccgccctcgcacggccgcccgcctccacgggcttcacccctgcccatcttcccgcacacggggccgggcgaccctcccacctcagcccgggatcgcgaacggctagcgggtgtcgccaggcggggaaacgcc

SEQ ID NO: 19269 - DNA, 380 bp, Homo sapiens
caggcaggcacatagggtccagagggaagaaaatcaagatgtcctccaattccatcctagatattgtaactgaacctaggtttgattgctcaaccctcaaaagccagacacaagagatgagggttggtgggaggaaaagcaggcttattcagagagccggcaaaactgagatggggaactcgtgctctaacgtaccatcttaaggcctggggtggtggctcatgcctgtaatcccagcactttaggaggctgaagtgggtggatcacttgaagtcaggagttcaagaccagcctggccaacatggtgaaaccccgtctttactaagaatacaaaaattagccaggcatggttgggcgtggtggctcatgcctgtaatccc

SEQ ID NO: 19270 - DNA, 408 bp, Homo sapiens
agaagtgcagttaagagatgggggccccttcttctactcagcccccacttgtggaacttgatcaggtatgccgagaatactaggacccagatcactcttgccttgggtattaagacagtggtttcactgtcttttgctgctaggagaggcaagctgagaggaccccaggctgctgtcctcccccgctctccatccaccaaactctcagttcctagagtgggagcgtcactcagagaagtttgctgttgtccccaaccccagctccagagccctaactctgagatttttacctgtggagaaaaacaaaccataaaacagctcctaatttcttcccaaaggaactgacttcatttgcaacagggagtgaagaagttcaaacctgattgtactctcaagaacagtagaggg

SEQ ID NO: 19271 - DNA, 454 bp, Homo sapiens
tgtggtgacactgctaattggtggtctagctgggattggaacccaagtctgtgtgaataccatgtccctaccctttaaaaaagcaaattttattttattttctattacacaagtaaggcatattatctaaaattgagaaaatactgataagtaaaaaaataaaaattatccataaattctgccattcagatataagagctacaatcacattggtatgtctttccagactttttttccgcatgtatatatttgtaaccagcttttctgcttaacgatatatcataaatgtctttctgcatctataaacgtatttctgtatcatttaaaaagactgcatagtatttcattttatgaatgaactgtttatttaactgatcttccgttgctaaatatttaggttatatctagctttttactaatattaaaaatgctgcagtaagcatccttgtagttt

SEQ ID NO: 19272 - DNA, 846 bp, Homo sapiens
ggggttgaggactggccttttctagggctaagcgtagtatactctaaaacagggtaataagcaaggggataaatgattggtgtttccagtacatggctcaaaataacatgttaattataaagttaaatagcctaataagcctttaggtaaaagccaaatattagaaagccatctaaatttcttaaagtcttgtgtttccaacatatttcgatttttaatagaggttcttaaaataaactccacatagcactattattttattttgtcagaaactattagcatgccaaaccatttttcactcttaaaataaaaattctgactaacatctcaacattcttctttacagattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgtaagtcttgattatcaatcagaatgcttactgtatattgacaacgtcatacatatgagccacaccctcatacaatctgtaattgaaaaaaagaacaaaaatttattggaagtaagtattttgaaaattcttattgtgtaagaatgtttcagattagtaaattttaaatttaaaatatgtacttagagaatatatgatatcatgtcacatgcagagtatgataaaggtgaaaaaatgaagatatacataaatattatactcagaaa

SEQ ID NO: 19273 - DNA, 1330 bp, Homo sapiens
  misc_feature (1322)..(1328): n is a, c, g, or t
attctctcacacctggttcagccactcaggaaatctgtatcagggcactgataggcgttatctcccatcttttctctttcagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacagacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttactagtgcgtagttggagtctgtccctgtcttggtgttaatgttgacattgttatataataaatgataatatatttannnnnnnaa

SEQ ID NO: 19274 - DNA, 3993 bp, Homo sapiens
  misc_feature (3985)..(3991): n is a, c, g, or t
agttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacaggcctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacagacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttactagtgcgtagttggagtctgtccctgtcttggtgttaatgttgacattgttatataataaatgataatatatttannnnnnnaa

SEQ ID NO: 19275 - DNA, 3810 bp, Homo sapiens
  misc_feature (3802)..(3808): n is a, c, g, or t
agttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacagacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttactagtgcgtagttggagtctgtccctgtcttggtgttaatgttgacattgttatataataaatgataatatatttannnnnnnaa

SEQ ID NO: 19276 - DNA, 3422 bp, Homo sapiens
  misc_feature (3414)..(3420): n is a, c, g, or t
agttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgcctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacaggcctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacagacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttactagtgcgtagttggagtctgtccctgtcttggtgttaatgttgacattgttatataataaatgataatatatttannnnnnnaa

SEQ ID NO: 19277 - DNA, 2498 bp, Homo sapiens
  misc_feature (2490)..(2496): n is a, c, g, or t
atttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgagagcagaaccttgcgcgggcacaggcctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacagacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttactagtgcgtagttggagtctgtccctgtcttggtgttaatgttgacattgttatataataaatgataatatatttannnnnnnaa

SEQ ID NO: 19278 - DNA, 2905 bp, Homo sapiens
  misc_feature (2905)..(2905): n is a, c, g, or t
agttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggaggtgagtttcaccctggaggactgaggggggaaataggtttctctttgcacttggccctccttggcttttcaccccgtcttagtcttgctgaatcttctcttgctgtgctgctgcttctcatgaacgaaataagaatggcttcgtgtgtcacctggcaagaatggattctctcgaaaggtttgaaaatccctattttgcttggtggcccagaccatctgtgctcaatgagctaagcaaatctggctgggctattacctgggagagtccagatttttcctctctggaggggcctgaagattatttatgggaattaattttatccccaaatctctgagaacttaaagggattgggaaggtctttctggatttccctttccctctactggagatgtagcggttcagccttcttccgatgccatgtttgtttttcgtgtcttcggcctagggtcgccttgccagcaagcctaaaggcctccaagctgacttggagggtgagggtgttttcacaaataaatacatcgcctgggcaaagggaaaatatctgtttgcaaacaaacctggaaggtggagtgagcaccatagcaaaggagggctggctttctccccggttgccccacattcagggttggagattctccactttggcattttgcagcaatggcctggcctgggattttagcagagcagtcacagagggttacacagctgctgacctcggggcatttctcctccctccatccctttctccagaccttgacttgcaggcccaagtctcttatcagaaccctagaaaaatcagtatgatgggggtacaggaggtaaggatgggaaacagaacaggactcctgacatttactccaagcaccaatattcggtgtcccaatctgggtctgctcagactgagacctactgactgtgtttgtgcttttattgacctcttcaactcacccn

SEQ ID NO: 19279 - DNA, 3040 bp, Homo sapiens
agttttgtcatcatttctattgttataattcttattcattttcccagccccgtccacacttctatttttcactacccccacgccccacaagttgccaccgggtcaggtggggacatatccggagagaaatagaaagggatgcattttaaagcgagttctcttttgagaggaaaacaatgggtagttttggaagtgtctttcttaaaaacggaaggagaaggtgaagaaaaaaattatcaacagcaatgggcccctttggtttgggttttgactttttaaagaggaacctctgctgtcctgttgcagtattaaaatcagggcaggaattttgcaaaatgagaaaaataaacttcgggagaaaacccagctgggagcagcttcgggaaagcgacagttctccgaaaggaggaagggaggatgcgcgctgtagccggctccggagtttactgcccgaacgattggggaaaagaacgaggattctcaaatctagttgcgatctctcgtctctcctttattctgttcgtggtgcgggcttcggagcgtctgggaaagccagtctgtgaagctggacttgcagaatcctttgaatgccggtccaggtggctgcagggcccgcagtccgggatgccggagaaaggaaccacaaggaaaagacgctacgctcggagtttccccttttccttgcagccccggcggggcctaggcctcggtttccggcccacctcggctcagaggtcaagtaggaactcatctcgtcgacccttccggaaggcccgacgctctccggctctgtgctgggcaggcctagctcttctctcggcgccaccaggggcgtctacgcggtacgttttgcaactcaacctagtgggtttccagcggtgcgcaaaagtttgcgagcatccaccactgcgctgcttagaaattgtgcccattgatcagactaaaaataatagtcgtcgtgattacaaaacaaaatagagtgcctcgtgcctcggcgggccctggtacaataattattctctacagaaaccacctctctccactcccacccctactccaccacccactcgcaccccgcccctgccgggccactctgggacgaattgcattcttggacctttctctccgcaaggcacattacggagaactccctctgtctcgtgtcccctccacgacaacccagtaattatttctatgcaagtctgcaagagggcactgagttatcgcatcccaagcctaaccagctagagcggcgcctcggtattcatttgcccagagctcctccgcgggggatttaaaaataataataataataataaggatcccatgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacaggcctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtga

SEQ ID NO: 19280 - DNA, 324 bp, Homo sapiens
acaatttttgttcctttccctgagttcctgctgctctgaaagataggaacttccactctcttaataattagtggcttacctctccatggctccttctggtggagggaggaggagggatttctctgattggtgagatggcaagagtctggtaccccctgggctctgtgttgggagtgggctgtgtgtaaaaagtcacttgcacatgtggcctctcttgggttctatgagcttgatttgaggggagggagacctctgttctctttgaggctgaatggaaaagtttctgttgtgggatgctaatcaggtctagacctggaggcaact

SEQ ID NO: 19281 - DNA, 1331 bp, Homo sapiens
tgtgcataagccacagataaagaatgtcttatcaaataattccacctttccctaacaatggttatcatttatttggcatagtgcaagattctgtttccatctttcctagttctcacaacatttattatcaagtagatattatttttctcattttacagatgaggaaactaaaacttagaaagcatcctgcaagagcagagccagttagctatctgcaaagccctttgctccaccaatgtcacattgcctagtcctttcgttttatgaagtctcatcttaagacatgataagtggaggaggatagggaaagacatttttcttaatttgcacaagagggaagtgaggttctaaagaacaaagcaagtcttagctcactcagctagtcagcagagcttggtgtttggggaccactatggcttatcccttttttatacccatccctttaggcccagctctgaaatcccacatacacctaaagtaaactaggctcctggatggggcagatgtacatatagttttcaatcatgggaatgatgacttttatttcaaggttgctcatgggatggtggggatgttgaggagggtggtgtcactggcagccacatgtgccttcagtcctaccatctgcatgtacaccagccaaattccaactggcacctcctgcctccacttgcctgagggttttctgtggccaccatggcacattttgccacttacatagcaggtttggaatgctggcgagttgcacctttcaggtgcaatcctcaaccgatgactactaagaacttggtgtataaacacccagacccctcactcttggaagcatacattctaccccatgttgcagagtttccccagcagaatgaagctcaactcatacatcaaaataatgggctttgtgagggatgaattcttgctgtcttttttccccttgtctcacttttcctacttcccttttggtgtttccccaaataaacctttgggaaacacttcctaaataaactctttgcattcaaatttcatctcattgcccacttttcgggagaacccaacctaagtcacctgaatataccctacatcaatactttccaaacctggctaatgatcagacagattgagaaagtctttgaaaaatataagtatgaatgcgttacccagatctactaaactaagatctctggaggttgggttcatgcctctgtcttttctgttaatctcccttcttctgaagatttagtgattagtcaggataccaacactgacccataaagcatcctgcactagaaattttttctggaacattgcacttggcaaaactttgctgccattaa

SEQ ID NO: 19282 - DNA, 453 bp, Homo sapiens
aaagtttggaggcagtggaaaattacataagatttagaaggattaaatctgtgactacacatattaaaattggcctgagtcttagtcttttgccctaatagctataggagtcatatcaaaagggaaaactggaataaactgttaaaaagattattttcaagggggttatgaggttgctcgccccattccatgatcttagacatcttgtagggacggtcaaccactgataataccagctcctattacacatctcttttaggtgttcttcaagctaatcaaccacaagtcaaggtcacctttcagacattccataccaccatgtcctcaactcttgtgttgcctgcaaggaccaatccagatcaggtgataaaaaaaaaatttgtcctcaaataaatttattattattaattatttcacatattaataaatgtaaaatttgattaataaagagta

SEQ ID NO: 19283 - DNA, 490 bp, Homo sapiens
catagtaatttctatttgatagaagctactgactaacttattacggcactggattagttctctttgattttttttttcttttgttagaagccctgtgtgtgtgtgtgtgtgcgtgtgcgcgcgtatgtgtgtgttgaggtgccagaaataagtactttaatactttttctcttggatggaaataattaacagctttgttagtctgaaaattttctacaaaggtgtcatggggcagtgcatggataatggttatggagaatatttcacttttgagtgggttttgtcagaggatgctgaaaagaaatacaaactgatgtgtgtgttttatcttgatgctgctaggatgctgttgttataatctgaccaacctgattttgtaagccttaaattgcttaaaaggcaattcctgtgaagaacaacactgccaaggatgctgtttcctaccgcccatatcacatcattggtgtgtgtgcaaacagcacaacaatcc

SEQ ID NO: 19284 - DNA, 576 bp, Homo sapiens
tcagctctgtgctgaggaggagagggttccgtggaatcttccactggccagctgggtagtgaggtgtgctgccagcctcagagggctggcgaggtggatgtggtttgaagaaaggccctacgggccttgtttcttaaagatgaggtgggtggccgcccaggctcaggtcagcggacacaggtgccaccgccaacatgcttgacttgggaagacacagcctctcctggcaccctccaccgctctccctggacctctgccctcagccccaggctgcctgagcccacaaagccctcagagcctgcaggccgtgttgcgactgcagggcaggggtggaagggggcttctgagtgctgtggagtggctcccacccccaccccggggtcagaggcacccagggccacatctgtctgtggtgctgtagccgcacttagtccctagacttgccagttttccactttgcaacttggtgaataccatttggaattcatagaaattgtatttggcttccatttggacggtagaaacaggaaatttgcagaatgctacaggaacttgctggctgtcctaggggtagct

SEQ ID NO: 19285 - DNA, 372 bp, Homo sapiens
gctgtcacacgtgactactgaatcactggaccgctgtttatgagacctaagaccctcagccccaggctgcctgagcccacaaagccctcagagcctgcaggccgtgttgcgactgcagggcaggggtggaagggggcttctgagtgctgtggagtggctcccacccccaccccggggtcagaggcacccagggccacatctgtctgtggtgctgtagccgcacttagtccctagacttgccagttttccactttgcaacttggtgaataccatttggaattcatagaaattgtatttggcttccatttggacggtagaaacaggaaatttgcagaatgctacaggaacttgctggctgtcctaggggtagct

SEQ ID NO: 19286 - DNA, 405 bp, Homo sapiens
ctgctcccattttcccgacacgttcaacgggggcagcttttgtacttttaaataacccattctatttcggtagaccttttctcccttcttttctaacagctcagtttccatacaagactcacagtgaactcaccattcccgagtggaaaggagtgactggttgtataaatatgtctgtctccacttggtctttgcctgaccgggctttgtgggggtctgttgattctttcagcttcactgccttccctgcagacccgacctggagtcctttgttgccctaaatatttttctcaaagatcttttattaactttttcttttctgctcttgtttttcttcctcttacctactttaccatgtggtcctgtggcaagagtgagaaagaaaaatacattctagtggtgtga

SEQ ID NO: 19287 - DNA, 461 bp, Homo sapiens
ggtggctgccatagtgaacttcatcacagcccatggcaacttcaaggctctgatctccatccacagctactctcagatgcttatgtacccttacggccgattgctggagcccgtttcaaatcagagggagttgatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggcaaaaaag

SEQ ID NO: 19288 - DNA, 446 bp, Homo sapiens
cctgcctttcaccccgccaatgtcatcttgcagtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggcaaaaaag

SEQ ID NO: 19289 - DNA, 397 bp, Homo sapiens
agtccatcagacctggaatcttctgcatcggcgtggatctcaacaggaactggaagtcgggttttggagatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggcaaaaaag

SEQ ID NO: 19290 - DNA, 268 bp, Homo sapiens
ccaaaatagtagtggtgtgaggtgtctgttgacaagtctcttctgggaaagcagatggaagtttgggaaatgagacattcaggcccctgtatctcagtgctccccttaccccgactttgagcaaggtactttgttagctgcatcaagaccaatctggctcaatatctcttcttcctcaaggattcacttggctgtttgggttgacgactcaggacaggtggtcacagagagactctttacggccttttctaagtagaataaagattca

SEQ ID NO: 19291 - DNA, 520 bp, Homo sapiens
aaggagaatcacttgagcccaggagtttgaggctgcagtgagctatgatcatgccgctgcactccagcacaatgattaatatcatgaactcagacccaatctgtgtgtgtttatatcctccaggctctgccacttatcagccgtgtgacattgggcaaatgccttcacctctctaagcctcgattgtttgaggattaaatatacttgtaatacatataaagcccttagtatagtggctgataaatgcttagtaagtattagctaatatttatggaaagaaaaccagatgtcaaaagtttaaaagatggagagaatgctgagatgtgtcagatgcacctaagagttccaataagctaaggacttattcattagatttggcaacatggaagccattgttgaccttgatgagaggaacttcaacaaagtggaggggcagaagccagataataatagattgattggtgaatagacggtaaagaaaatggcagcaacaggtaggactaactttttcaagaagctt

SEQ ID NO: 19292 - DNA, 418 bp, Homo sapiens
aggagtgccgtggtgcagtcacagctcactgcaacctcaacctttagggctcaatcagtcctcccacctcagcctctcaagtatccgggcctataggcatgcaccactgtgcctggctaagtttttgtattttttgtagagaggggattttgccatgttgcccagagtagtctcaaactcctggcctcaggtgatctgcctgcctcagcctcccaaagtgttgggattacaggcgtgagccactgcacctggccatttttgtttgttttacattttaaaaattgacgtataattcatgtaccataaaatttatcctgttcaagtgtacaatttagtgcattttactatatctaaaatgttgagcaactatcaccatggtctaattccagaacgttttcatcacccccaaaagaaacct

SEQ ID NO: 19293 - DNA, 243 bp, Homo sapiens
tacaactctaagatagttgaaataggaactttcttatttagttgcatcatgaggaaatttgagatgatgttatctgccaagcgcagatctctccaaaggatttcttctagccttaattatccacctcacaggacaaacctttgccattccccatctactttttctttcggctcctcaattcctgacacaacaaagttgtacatatttcccacactcttggtttagcagagttcttttatcagt

SEQ ID NO: 19294 - DNA, 1528 bp, Homo sapiens
ctaactatggatggaaaatatttgaaaaaaataattacatctatactaaacatgtgcagacatttttggtcattattgtctaaacaatacagcttaacaactgttttcatagtatttccattatattaggtattataagtctagagatgacttaaagtatatgagaggctgtccataggttattatgcaaacactacgccattttctatcagggatttgaacatttgcagattttggtatccataggatgtcctggaaccagtcccccactggtactgagggacagctatacttaaagactaatatatatgctctgttttcctttagagtacttgactctacacatttcctatagctttgaagacttgtcttccttgaagcagactaaaagggggacagatgggaggatgggaagaaccacacttccataatcttagaattattccttccttgctatgctgacaaagtgagaaaacaaatataaattatcttaaagcccagcatttaagacacaagttggtaattacctaggcttgaaactttctaatttcactggttttttcgtttgcttgctctttatttttctctggcttaaaatcagtggttagggtgaatagcacaggtcttgggggtggtatctatttctctaggtcacaaatttttttttaaactatttcaaggcaacttatttctagttttcagtagtaaattgtttaaatttcaagaaaaatggtacagtgaagttagatttgaacaatttaagaaaagctaaagaatatgtagtttaaaatcttagagaaggcttaaagatgggattatgtctgagaatctgcagttacccagaaaaaggatttaaattgcatcaagagaagtttaggttaggcatttgaattgattttattgtaggagaggtcatagactgaatatttttaagaataaaggtaaatcggatggttgccgggtctgtgtggatagaagtagacatgggagacttttcattttgttctgtactaagaaaaattcttctgccttgggatcctgtcgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctcatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaattaaaaaaaaaaaaaaaaaaaaaagaataaaggtagataatggtctgccttgatttcgcttagtctttcctgaaaatgtaaccatgaccctttgagagacctttcaagtcttatttttctatgagtaaatttgaagtatttcagatggcatgcttgataaggaacttaatgaag

SEQ ID NO: 19295 - DNA, 851 bp, Homo sapiens
atccaaaacacataccttaacaaatgtctatatatcaatagattatctagacaccgctttaaatgtgcagctatcacttaaaatcaactgatgggttcaaaataatgtaagaatctcaagatggcatacaaatgcgccctgaatgatgagagtacatggtactttttataggaagatgtcactatcaacacaaagcatattttttattatttatttatttttagacagagtctcgctctgtcacccaggctggagtgcaatctccgcctcccgtgttcaagcgattctcctgcctcagcctccggagtagctgggactacaggcgcacaccaccacacccagctaatttttgtacttttagtagagacagggtttcgtcatgttggccaggatggtcttgatctcctgacctcgtgatctgcccatcttggcatcccaaagtgctgcgattacaggcatgagccaccgcgcccgtctgaaagcatattcttttaaggttttgttattgtttttccatgtagcactgacagatttgtactaattctttgcttctctggttgctagatagctttagaattgtcagctgaggctcttgaagagcaaaactaaactaccttagttggcttagatagggaaataatctgacttttaggattatttgcagtataaatgatttcaaacactaaaggttgacaaagaagcatttatagttcactgagaaggctatcttatttcagattccaggtaagcagaatcacttaaatttaaaagagcacgctctgtgttgatatgcaaaactttgttaaagtatacgttttgatctttaattcatttattagttacaaatgtta

SEQ ID NO: 19296 - DNA, 366 bp, Homo sapiens
tcataataaaagatgacacttagaactggatcacttggccctttctcttcttatctcctcccagttcaaaatgcttgcatcttttaatagccagcattctcttagatctgcagttgggctcaacgcactcaagccttagcacaatcttctttgtagttttagcctttttccggaaaatcggcttagtttgcccaccatagccactctgcttcctgtcataacgccgctttccctgggcgtacagagaatccttgcccttcttgtactgtgtcactttatggggttggtgcttgccacacttcttacagaaagtccggcgggttttagggacgttaaccatgcttggtgagcgctatcggtcgacgg

SEQ ID NO: 19297 - DNA, 511 bp, Homo sapiens
gcctggccaacatggtgaaactctgtctctacagaagtacaaaaattagtcgggcgtggtggcaggcgcctgtaatcccagctgcttgggaggctaacctgggagaatctctcgaacctgggaggcagaggttgcagtgagctgagatcacaccattgcactgcagcctgggcaacaagagcgaaactccatctcaaaaaaaaaaacaaacaaataataaaataataataataataataaaaaagagggtgggagtggaccaaggcctaatggcatggaatttgcaaactttatcttcctagttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatctcgcctgaccttgtggagactgaccactccctccttc

SEQ ID NO: 19298 - DNA, 380 bp, Homo sapiens
tgtgtgggttaaattagttcattaaaatgtttataactattcctgacacagagctaagagctttatgagtgttagattttatcattactatattttcccatgattttaagtcatattttaaacgttagtctaatgaaaaggcagtgttgatttaaaaaaaaaatgtctaagcatagcttctaacttttattcaacaaggcaaaatgccaatgaaagctttcagtagaattccatatgttgtggaatatacagttttaccaactgtggggaaaatatcacagttttaggtgcttgaacctttgattgccagtttcccatgattaaagatagacatctaaatttttaatttatatttattttgttagaagcaatagtgaggg

SEQ ID NO: 19299 - DNA, 531 bp, Homo sapiens
acccaatacaaagtcatgatcccatcctcaatgcctagacctcagccaaagttcagattcagatcccagtgacagaggaggagtccatatccctaggaggaataccctgcaaccccgtggaagtaaatgctggcacaattccctcagtccttcagcaaaggaacctatagccatttactcaggagattgtacactggcgaaaggaaagatgcagaactggtcagattattgacactgagtgagagctgacattgatgcccagatgcccacagcactatcatgtctcccatcacagtggggcttacggaggtcagggagtaaacctggacacattacggcccacaatggaactactggatccatagacccagccctggttatcttccaattccctgagtgcataattaacactgatgcactgttaagtggagtcacccccacactgggtccctagtctgtggagtcaggactctcattgtgctgaaagccaaagggaaacctctgacgctgcccacatcctggcaaaaaaaa

SEQ ID NO: 19300 - DNA, 464 bp, Homo sapiens
ggtgagttgtctgtttgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttc

SEQ ID NO: 19301 - DNA, 287 bp, Homo sapiens
ggaaattctccaagagcaaaaataaacattccaaatggcagacactagtggatgactaattaaaagccatgagggcagttgccatgatctaaaataccagtccagacgcctgacattctctggtggatttacaggattatctttgctcttgagagattaataagaaatggaatgggattcacaaacgctaaggcatgccaggttttctgaggctccagccagctatataatatggcccattcttatgcatattttttaactgatgggcaaattacgtgaaggaaaat

SEQ ID NO: 19302 - DNA, 693 bp, Homo sapiens
gatttttttccagtattatctttagtacagaatcttttcctctctaagggcctgagaccctctcttaggaatagaagtacagttttcttccccactccttttgtccagaaggaaaacctggttttacatcagaaacttgaggtactttgaaaatttgccagctgccttgaaggagagagggcttgagtgtattttgggggaagaatgaggggacaacagggcagggagaagggacagagctagaggaaggacaggcctgtgccacccaggccagggtaaggggagcagagaccttttggttcctggtttgtgacacaggaagggagggaactggggaggacaggtcatgatcagtgtttcctgattaaaaattttttatttttatttttaattatcatgggcacagagtaggtgtatatatttgtggggtacatgagatgttttgatacagacatgcaatgtgaaaaagcacatcatggagactggggcacccatcccctcaagcatttatcctttgtgtcacaaacaatccgattatattgttttagttatttttaaatatgcaattaaattgttattgactatagtcacccttctgtgctgctgctctactgtggcctcaaagatcataaatgctgtgggtgctggcaagatactgaaataaattaattctgtatttctaaaaaaaaatca

SEQ ID NO: 19303 - DNA, 451 bp, Homo sapiens
gcctttaatgtttcccgtcccgctttgacaccaataatttcaacccaccctaacatatctgcagcgatgccagacgagatgcctattctctaaagtgtatggaaaatggacaccggtaagtcaatgtcacccaggatccgtacaactgcagtaagagggacggttaattcacagcttccagctcttggcgccagagtccgatgcactcctgcagataacggtcatttccattccgggagaacctcttcgaaaaacaacccggatgagactatctggcaaattgcagcccttggcgggcttttcaaatagagcgttgaccaatcaaagaagggggacgttacaggcactgaaagaataacccggccgcgcgcgatggctcacgcctgatatcccaacattttgggaggccgagatgggtggatcacgaagtcaggagttcgagactagcctg

SEQ ID NO: 19304 - DNA, 293 bp, Homo sapiens
acaatgagaatgaattttcctattccatcaagatttctatgtggccatctcttcaggacataggtatcagctactgttttaaatttaggaaatgcacacacatatgcaaccaaccacataatgtttccaaagcaatatattgagattgatacaaatacacatttttcaagaatcctggactaatcccacactactctgagccgcctttactttttaagcctctttatttctattatatgactgtgaactaagtagatttaacttttgtatgcttttaaaatcagttatatttt

SEQ ID NO: 19305 - DNA, 428 bp, Homo sapiens
tgatgattctttattcacctgattacttcttggagaattaagagaaaacaagtgaaggtagatggtgagtttatcaccagcagtagttggaactaattctagtacttaatcatgtcttaactaaggtcctacaaatgtagacagctattatgaatattgatattttattcataaatcaggccaggcacagtggctcatgcctgtaatcccagcacttttgggaattcagagctggacagattgcttgagcccaggagttcaagatcagcctgggcaacatgacaaaactctgtgcctgaggtcccagctacataggaggctgagaatcacctgagcccaggaggttgaggctgcagtgagccgtgattgtgccactgcactctagcctgactgaaagagtaagactttgtctcaaattttcatctctc

SEQ ID NO: 19306 - DNA, 489 bp, Homo sapiens
cccagctgtccagctcctgtaccacccagtggccatcagaagaaagtcctgctgcctgtgaactcccatctccctctccccaaccctacaggagatgttctggagacccacatgcgggggtgtcaaactcctatcccttaagcagcagatctgaggcccaaagtgcaccagagaagccacaaacagccccgtggccagccagcacctgcagtcactggtccacgttcctctcattcagacaaggccttttctgtattttgtttgaagctgttcaaaaaagagcatgtgaaaccacttttaaaatccctccctccctttcctgcccaacgcacctttttttccctcccctgactgttccatcgcttaaaaatggcttaaccaatttgggttatttttagaaaaatgctggtatgttggctgacaacctatattctaagtttcaacctgatatggaaaagacagagtttataaacccctaggagaaaaaaa

SEQ ID NO: 19307 - DNA, 427 bp, Homo sapiens
caggccagctaaatgtccgtaattatagaagggaagattggacaataaccagcagtcctatgtgggtttggagccttgataaatacattgcatatttttattcatggactctgatctctccttctctctctctctctcacacactccttgtccttcttacctgctttccttctgcatagaactaatctcttaaagctcctcaactcacttttgatcgttagaggttagaacctctaacgtttgatcgtttcttggttaaaaccaagaaataggaggacagaaagccaagcagtcctttccatatctttcttgagatctgggaaaacaaaaattgttctttttttttaactgagtctatgtgttaatttcactgaggtaatgggatggttctggaattctgagtctacagacccttgataaagttgag

SEQ ID NO: 19308 - DNA, 405 bp, Homo sapiens
ctttaagaactgttaacactcacggcaagggtccgcggcttcattcttcgtcagtgagaccaagaacccaccaattgtggacacactatctttgtcctcgggcaagccctcttatagtgacaagttcgaggtgctaactttcactcatggctatgcccttaagaagattcatccaggaatcattacacaaacacaccacaagagttttcatgcttcaaacatgaagggagttgtgagtggttaggaatgaactacatgcagtgaaagatcccagaagaaagggtcatttgaatgatgcaacctaaacctaaccctggctagagcctatcatagaacctcagaacactgttttcataagcacttattgacagctagatgatccaggatttgggaaagggtgacaaa

SEQ ID NO: 19309 - DNA, 614 bp, Homo sapiens
gcactccagcctgggagggagaacgagactccatctcaaaaaaaaaaaaaaaacaaccagttggaggtactaagctctgggactgggccagtgtgatggctccacacctgtaatctcaacactttgggaggctgaggtaggaggatcacaagtccagaagttcgagaccagcctgggggagcatagcaagaccctgtctctacacaaaatacaaaaattagcctcgtgtggtggcacacacctgtagccccagctacttggtagactgaggcaggaggatcccttgagcccaggagttcaaggctgcagtgagccaggatagtgcacacggcctgagcaagagcaagaccctgtttcagaaaaaacaactctgggactggagtgctttagacagatgggagaccaagaatcaagttttctggaggtgtttttcgttagattgtaacattagacattttattaaaaatgaaacaagtttgatgtgtgtgcgtatctgaatgtttttatctttgaggtaggataatggcagtgtgccttctgaatagcttctgtaaataacccttcttttctacagtggttaatacaaataactgcccataacactcattttaatc

SEQ ID NO: 19310 - DNA, 433 bp, Homo sapiens
aacaatctgatctctctctcttttccccacatttcccccttttctattcgacaaaaccgccattgtcatcatggcccgttctcgatggtcgctggatgttttattttccagagaaccaaaccttagcactgtgcacgccacacctgagggcggattatcccaggccagcccaagtcagggcagggctggaaactaggggcttgttgcccagcgaaccgccacaacagagagcggactcgatcctgcgctccggccgggctgacctgcctgcgtccagcccccgcgccctgggcctgcctgggtctggatctgtgtccgagtctgggtctggatctgggtccgagtctgggtctggccctgcgctcagggcccgcggaggagactatggaccccgccgggcgcgcccggggccaaggggccacggcaggggggc

SEQ ID NO: 19311 - DNA, 409 bp, Homo sapiens
tctggaaatacctgatggaggccagtggaaaagagtttgcaagttcatgtgcctgtggctccgacctattctaacttgatatgctagcccacttggccttcaagaatctgttaaaattttagctgctttctttttacccccttgtatgacagcatcctatttcagctatgctgtaacaaagatgaaactccttatgtgtcctgtctgtccttggaggtatatgtcacggtttggaattcagtttactaggttgccttatgatcacaaatctttgatggactccagaaaagtatgattttgtagatcagcagtcctctgagcctttttggcaccgaggaccagtttcacagaagacagttttttccaggagagctggagagggtttggggatgaaactgttccacaagga

SEQ ID NO: 19312 - DNA, 470 bp, Homo sapiens
ggagccagcggtgacagtgtgaaggtctgtgtggtcctgttcagccctgctcaagtttctgtgtatctctcttatcatttgccacccccctctattctgaggtccttcccctgcctggggtgcagtggctgggctgaaccctaggaagagtttttccagatgtcatctaccttcttcatgggataagtgaggagggggaaggaaagcaggtattcccagtggcaggcaatgccttggctctgcgttttcctctctcctgcagaggtgctgatggttggaaaagcttcccagcggcctgcaaggcctgcacgtaggcagtctccagtgctcattagaacagcctcactcagttcatctcattcgatccctaaaactgtgggatggaaggaggacaaagaaaactgagtcctcttgtctccattcttggtccactccattccatcctcaacactatcctcatagtgatttaa

SEQ ID NO: 19313 - DNA, 299 bp, Homo sapiens
ggttatatggtaactttgtttaacttttgtttgtgttgttttgttttgtttttgagacggactccctctgttgcccaggctgacgttcagtggaggttgcagtgagccgagattgtgccactgcgctccagcctgggcaacagagtgaaactctgtttcgaaagaaagaaaagaaatgactaggacagcaggagtaaaaccccaaggcattaggtctccgtagctaaggtggatcccactcatgcaattcatcaacctttgtctgaaaaaaaagaaagaaaatctgattttgttaagct

SEQ ID NO: 19314 - DNA, 358 bp, Homo sapiens
tctttaatggttggaagcaaaggcatcaaattagtcagaaaaggaaggaagggaatgggcagattaggagagaatggctaaagtcactatcttatctccaaaggcagctgtccttgttcctcactatgtctcatttaaccagtctgaagttcaaatccattcttcttgtacagtagtccccccttatccatgggggataagttcgaagacccctgtggatgcctgaaacctcagatattaccaaatcctttatgttctatgtttttttgatctagatggctactaagttactaacaggcatgtagtgtagacagtgtggatatgctggacaaagggatgattcaagtcctggatggac

SEQ ID NO: 19315 - DNA, 256 bp, Homo sapiens
agtgtgttcttaaagtacatactgccaagaactctctctgttgcttctcctggcactttcctaagaagtgtattccaaaaaatagttccacaggtgtctcatagaaaagggttcaatgtccaagttttgggaaatgctaggttaagacataactcgttcatatcaaacttcttatgatgtttgttatacatccccaggaggaaaggacatggtacacatattcattggcccacagaccctttgctttatatccttt

SEQ ID NO: 19316 - DNA, 448 bp, Homo sapiens
tacaactgcctaatggaaattcccacctggatattccattggctccccaaactcagcaatgtccaaatctgcttttcctttcatagcgcccaactcatttattgatgctatgctgctaatcaagtaaactaaaatctgaagtcatcttgcctctcccttcccactccttgccaccagctcccacctacccctctgctgcttaaatgtgcccatgccccaccactactactgttttacattacacattcctttccctcccaacaggtgcttgtcccgcctgcaacccatttcttacaatgctaatgagtcatttatcagagcagtaatgagttcaggcgagtgatatatcagagcattaatgagttcaggtgacttactaaaaaacagtggttccccactgcctagccaggaagagctagtacagcattcaagacttttcatgatccaa

SEQ ID NO: 19317 - DNA, 91 bp, Homo sapiens
caattgcgggaatatgaagcctttggtcaatatttacttcgcttcctggccaacacatctccctaagaacaacacatgagatttgtggagc

SEQ ID NO: 19318 - DNA, 1604 bp, Homo sapiens
gtagctgggactacaggcgcccgccactacgcctggctaattttttgtatttttaatagagacggggtttcaccgttttagccgggatggtctcgatctcctgacctcgtgatccgcccgcctcggcctcccaaagtgctgggattacaggcgtgagccactgcgcccggcccccaatttcttaatatccttgccaactgttgttattttctgatttttgtttgttaagtaatagctatcctagtaggtgtggggtagtatctcattgtggttcaaatctttttttaactttaaaattctttcaatgcaaagactatatcaaatagacatttaaataattttttgaccgagattttgtttatggttcctctctttctccttttctccaaatataagtagcggccaatttagtcatgggaaagataacaactaatttctttattctgtaatttattgtaaatatatcaggttcaatttgtgtaaatactttgtattttccttagtcctatatgtgttaatcttataatggaatgaacttattcatatatttatttgaaaactaatgtgcaaagtattgtcttaagtgcagagggtacgataatagtaaacaagaaaaacgaagactgctgttacgtgaagtgttctagttggggagacacattaaacagatacaatttcaggtggtaataaggtgatgaagaaaaataaaaataaagcagaggagaggtggtttgtgcaggtgctactgtaggtaagctagttttggagagcttccctgaggagctaagatttgaccagagactcaatgatatgaagatggaaactatttgaagatctgggaagaaacattccagatagagcatacacttagtagaaaggcctttatcaaggaataaatttgtggttttcaaggaacagtaaaatgtatatttataaaccatagggaaaccacctaaaatttttttagagaaaaatatataattaggtagcaaataacagagataaaattgagtaatttaagaaattatttaatcaggaaaaagaaaaaaggaacagcaagtaagtggatcagatagaaaatttggaagattatagattttattccaaccatatcaataattatattaaatgtattttaaatataccaattataagattggataaaaagttaaaacatatctgtaagaaatttgctttaaatacaaagatcttgttaggttaaaagtaaaagaatgcgccagcaatgaataactagagaaggaaattaagaaaaaaagtccattcacagtagcttccaaaagaataaaatgcataagaataaatttaaccaagaaggtaaagacttgtactctgaaaacttgtactctgaaaaaaaggatgtttactcatttgtcaaaataaagaagatataaataagtgaaaatctatctcgtatttgtatattggaagtcttaatgttaagatgtcagtactacccaaaatcacctacagattcaatcctatcaaacctatcaaaattcccatggacttttgcagaaatgcaaaagctgatcttaaaattcacatggaattgcaagtggccttgaatagccaaacaatcttga

SEQ ID NO: 19319 - DNA, 325 bp, Homo sapiens
ggtggctcttacctgtaatcccagctctttgggaggctgaggtgggaggattacttgaggccaggagttcaagaccagcctgggctacatagcaggatccaatctctaattaaattttaatataaaacattattttaaaaaaggaaaacaattctcccccccaaaaaaatctctgggcccatatgatttcactggagaattctgtctatcaaatgttgacgaatgagttaacaccaattctacacaatctcttccagaaaatggaagaggagaacgcacttcctgatcaattttataaagctcgtattacctagataccaaacct

SEQ ID NO: 19320 - DNA, 428 bp, Homo sapiens
tggggacctagctggcttcatttagctttacctcttaaatggtataacataaacatcttgtcaggggaatgggttgtgattcaccaagagttgccatatacattgtatttcaaatgctaagtttcagaacaacaaatacaacaaaatctgaataagcattgatctgcctttgaaaatactttgtgatttatacaacgccttgaggttagctttccaaatattgattcttgatggatagaaaaagaccagaagatggaaagttaaattgacttgagtctttctaaaccttttgacacaccctagaagttgctcttttgaataaataaatcccagataggaatgtatttctcatctagctttttctcttgatgtcaagtgtcagagaaataattctagcttttagaggttggtggttgtttagaaactgg

SEQ ID NO: 19321 - DNA, 563 bp, Homo sapiens
ctttatgtctgatcgcttattatccagtttctcttactggctctgagatataggtatatgccctctaggagtctaactgtgacactcttctctttctgtgatttctcctattacatgaagcagtttaaagtatagccacccctgttaaaggaagaacagataggttcaataaacacacacacatattctctagatgagatcacttaacattatttttcctcatttctttactccaagcctactttttgttatcctttctcccaaatgaaatttagactcagaggaactgatgttaagctggcagttccttggtagtactccttgcaaatgatggtcttccactcccttgttctgattccaccaagaatctcagaagagttaggacaagtatattgtaaatggtcataatcctaagatttagtaatttatcttttcactcattcttaatttagatggtatctaataaaagctaacacttcttgggcacttactgtgtgctaaataagtcaatacacatgaaggatgtagctgttctgagcccttcacatgtatttattcatctc

SEQ ID NO: 19322 - DNA, 704 bp, Homo sapiens
agaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttg

SEQ ID NO: 19323 - DNA, 394 bp, Homo sapiens
ggaggggttgctcccgagtccgtggcaggaaccagaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttg

SEQ ID NO: 19324 - DNA, 398 bp, Homo sapiens
tcacccagtctgctggcccctttggctcctaagaatctgggctctgctacccacctccggagacacaagcccacgtatctactttcacttgctcatccttgctctacctcaacgtggggccctgacaccacgttatcaaacatgcagcccccacacccctcgtctgcccgcccccagatcttccctctgtgctccctgccaccccagcagctgttgatttcagaacccttgccttcgccctgctggccctctcctccctgcccttcttcctgcccttcctctgaaaagaggcatttcgggaaggcttgctttttctccatgtctcccagtttgtatagttaaattgtccagttgtatagttaaatatttgatcttattaaaaacatttgtctgcaaaa

SEQ ID NO: 19325 - DNA, 371 bp, Homo sapiens
caccccccaccccaggctgcccaccccctccagagaccagccagcccaccgccaacctctacccaaggttaatgctgggggtgggcaggcaggtgggcagggaaggagctgaagatgagaaggcagaagtgggaagagggtgacagctccagggtgcctgctcaagctccaggcctgggctgggccctccagccaggtggggcctggatgcctgggtctggggagggcagtgtagctcagagggtccagggcttggggggcctctcagacagtctgggtttcactctccagggaagacagaagcctctgtgtgtgcaagcgctgacctcatcggcaaccgagtcaccccacccctcctggtccttttaaga

SEQ ID NO: 19326 - DNA, 387 bp, Homo sapiens
aacatgatagagattttattggaagaaactaaagataaaccaacagttatcacactagtttcactgctatgctctttcaaaatatatctggcatgattattatttttattatatatgaaggaaaaggaaatcaacataacatgtatgttatataattatttttgaggacttgatttgtaaatctcagtaaataaccaagaatggaacctattacttaatctgtatgaaatgttttatctacttacccctctcttaacccaagacagcttttcaatcaagctgcttgaggaccatttattatgaaattttgcatgcttatcacctaatactactggcttggcactagtaggcactcaataaatatttgtttaatccattaacctttat

SEQ ID NO: 19327 - DNA, 480 bp, Homo sapiens
gcagccctcagttcccctcatggctctctctttcacttccctccatgacaccacctcatcgagttgaagatgttattgatgagtgcagtgggtgtatagtgtcctcccaaaattcatgtccacccagaaattcagaatgcaaccttatctggaaatagaatctttgcaaatgtgattagttaagatgaaatcatactgagttaggatgaacctgaaatccaatcactggtgtccttgtaagaggaaaggtcacaaagagacagaggagatacacagaggagcccatgtaatgatgggtacggagactgacgtggcacaactataagccaaggaatgccagggaaggccagctagcagaagctagggaaaaacacagagggattctcccctggagcctttggagggagtgtggccctgctgacaccttggttctggacttctggcccccagaactgtgagaaaataaatttcttttgcttg

SEQ ID NO: 19328 - DNA, 1636 bp, Homo sapiens
aatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19329 - DNA, 649 bp, Homo sapiens
gacaaatgcaaattctcaactcttgtgttccaacacgtttccaggatgaagataggtcttacagtgtaaaaggcagcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19330 - DNA, 1149 bp, Homo sapiens
aatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19331 - DNA, 631 bp, Homo sapiens
ggatatttacataataaaatttgttagtttttttatttatggcttctgaatttcttttttttgagacggagtcttgctctgttgcccaggctggagtgcagtggtgtgatcttggctcactgcaacctccgccttctgggttcaaatattctcctgcttcagcctcccaggtagctgtgattacaggcatccgccaccatgcccaactaatttttgtgtttttagtagagacggggtttcaccatgttgaccaggctggtctcaaactcctgacctcaggtgatctgcccgccttggcctcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaagaaaatgcagttgccttattaggcttttttgatttacctattttcctggaatatcagtttgtctttaaatagctaagaatctgacttatatgctgtcgggctagtcggggctgtcgggctagtcggggctgtcgggctagtcggggctgtcgggctagtcggg

SEQ ID NO: 19332 - DNA, 1825 bp, Homo sapiens
aatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccgggtcttgctctgtcacccaggctacagtgtagtagcgtaattacggctcactgcagtctcaacctcccaggctcaagtgaacctcctgcctcggcctccagagtagctgggactacagaccccaccacatccggctaattttttgtagaggtggggtctcactttgttgcccaggctggtctccaactcttggactcaaccaatcctctcacctcgcctcccaaagtgctgggatttcaggcgtagtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19333 - DNA, 2638 bp, Homo sapiens
aatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacaggtgagaacacattttattttctacaattttattttatgatctatattttattccttcttgcattttaagctctattttaactagtgttttgctccatttcttaatttctttatttctgaagattatatctttctagtgtagataagactatcaaaaataaaatatttttcaaaaaccagctgatccaacatagtgaactacttctggttgagagccctggtctaagttaataaatttcctttaaggctatttatatttttttcaaatataagactaacatttatttttaaactaattagaatatattggctgggcactcttgcctcattagctcatgcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaagaaaatgcagttgccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatccaagcttgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19334 - DNA, 1708 bp, Homo sapiens
aatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacaggtgagaacacattttattttctacaattttattttatgatctatattttattccttcttgcattttaagctctattttaactagtgttttgctccatttcttaatttctttatttctgaagattatatctttctagtgtagataagactatcaaaaataaaatatttttcaaaaaccagctgatccaacatagtgaactacttctggttgagagccctggtctaagttaataaatttcctttaaggctatttatatttttttcaaatataagactaacatttatttttaaactaattagaatatattggctgggcactcttgcctcattagctcatgcctgtaatctgagcactttgggaggctgaggcgggaggatcacttgagcccagggtttcgagaccagcttgggcaatatagtgagacctcatctctataaaagaaagtaaaaaatttttaat

SEQ ID NO: 19335 - DNA, 1352 bp, Homo sapiens
ggatatttacataataaaatttgttagtttttttatttatggcttctgaatttcttttttttgagacggagtcttgctctgttgcccaggctggagtgcagtggtgtgatcttggctcactgcaacctccgccttctgggttcaaatattctcctgcttcagcctcccaggtagctgtgattacaggcatccgccaccatgcccaactaatttttgtgtttttagtagagacggggtttcaccatgttgaccaggctggtctcaaactcctgacctcaggtgatctgcccgccttggcctcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaagaaaatgcagttgccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatccaagcttgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaat

SEQ ID NO: 19336 - DNA, 317 bp, Homo sapiens
gatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactggtgagtggccgggtcagtgggtgacgtgccccgccaagcttccagccggcccccgtcgccccttaccttccgaggccgtcgggaggacaagagcgcggtcatgccgcg

SEQ ID NO: 19337 - DNA, 493 bp, Homo sapiens
agcttttgtataaaattgggtgagcttattaaggtgaactcactttctgattcatgtatagtgcaatattctggcagtacctggttgaagtgaaaagacctaaagtcctgtctcctttaatacaaaattcattttaaaaatgtcccagtagagggctgagcacagagggctaaggttttaacaaaggcttgtttaattgaaatgaggacataaactccaagaggtagcggaggagagaagttagggaatctgctgaccccctcctctcagttcttggctgctgcccgagttcatctttcttcagttcgtccagccctgcaacaaaagagcgcttcagttcagcagagcagcgtagagcttgcacgcatgctgagcaggagggctgtcgagagaaaccgtgtagtaaatacagaacgctcattgaaatgccaagtgtcactactttggcatttaattatctgacttgctggcagctggaagtagggaagcaagc

SEQ ID NO: 19338 - DNA, 431 bp, Homo sapiens
tgtccctgacctcctcacggttcactcagctttacacaaagctcaaaccccaccgagagaggcctcacatcatgccattacactcaaaactgaaagaggctacctcaggacagctgcctctgcccttctgagtaaactgtagggacatcactattcagaaatgcaaagcattcttcccctgaaagtcagatccgtgccaagctgtcattctggaagcttgcacaggttaggggacttggcattcaaagctcaaatgaacttggcttcaaagtcacccaatttctgagaagacaaacatgaactctacatcctggatgggtctgcagagtccaaaatgaaggccgtcaaccacaagccaattcattcagtagtgtagttaggtccaggattagccaaattgtcagcaatgattcagtaaaagtcatgataag

SEQ ID NO: 19339 - DNA, 471 bp, Homo sapiens
cgaatcacccacaaggaaggaaatgaaaaggttacaccaagaattgtcgatattataaatccctgtagtctcgcagcctctctaaatgttttgatagcagaatttgatggattgtaaatcagagcaggcttatcttaaacatttgatagtgccttatttatttatgtatgtgacacataaaaccagaattgattgtttcttctttctgtcttagcaagatttttttttctgctttcagaaacacatcactcttctctaagccctggttttccgtgtttgtgggcgtgtaggtgtgtgtgcttgtacatggtggcagctgttacgattctttccacacggagaaagaatactttgcctgggagaagattataacatcaggaattaacagaaaaaataagaaagccgctatgcttcaaaatatgtcttaatcttattgctttaaaaaaaaataaaacaagattattgctcaga

SEQ ID NO: 19340 - DNA, 472 bp, Homo sapiens
gaaataaagtgcctaataaatgcaaatgtgcttacatcttttggcccagctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcagtaagttcaggtagctgggactgtaggtatacatgatgatacttggctaatttttaaattgttttgtagacacggggtctcactttgttggccaggctggtgtcaaactaatggcctcaagtgacccttccacccctgcctcccatcctcgaggcatgtgccaccacaaggagcacttgttcaattttct

SEQ ID NO: 19341 - DNA, 186 bp, Homo sapiens
aacaacatgggacagttaagcttttcttgctttagtttcttgacgtggtttaaagcagaagattgaagcatacaaatgaatgtaccaaattttcctcatcctgtttttaattgtaagaatttttcattcactattaaacttggtgtaaagatttcaccttcatttttatcaactgaacacacagta

SEQ ID NO: 19342 - DNA, 326 bp, Homo sapiens
gggacatagttaatgtgaagatcacagaagcaccatctttggtgttttctaaccattgggtcttcacattatggataatgatcaaacactccagcctcttgttgtatcagagcctagacagaaggaactcaaagtctgagacctcctgctcttgcttatctttttccctacttaggcataggactgcaatactcttctttgatgtgggaagggataaacagatgcttggagaccaatgcaatccttcgtaaatgtctatgatgctataaactggcgacaggatccaaacctttgttgtttttatggtagtggagggagatgtgttt

SEQ ID NO: 19343 - DNA, 415 bp, Homo sapiens
gtcatatatatatatatatatatatatatatatgccagagatgaacaagcattagaaaattaaatgcacacaggtcatgtcagtgctatgtataatgtggtatactaagtatagatgttcaacagtgtgggatctaggctggaacaagactcctagtcttaagcaattctttctaggttcagtctctggaaataatgccttggatcaaatgtgtgagaaaatcaatgggttttaaagactattctatgtcaactataacatttaatttggggatttctgtcccttataatgtctacctcattttggatggaatccttgaggcctggtttatttttcttttcctttctacacatcgctgctcagagtgatgaatggagttgtgttttgaataaaatatctatgcatccttttgtga

SEQ ID NO: 19344 - DNA, 2134 bp, Homo sapiens
atcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacagtcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatggtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactcaaaaagtct

SEQ ID NO: 19345 - DNA, 1568 bp, Homo sapiens
atcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacagtcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagcgaatggattgttaaaactctgcatgtcaccatttattggctgtttggacacacctct

SEQ ID NO: 19346 - DNA, 2012 bp, Homo sapiens
atcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacagtcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatggtagcagttgctttgtatattaaagtgatccttgtgaatttgtga

SEQ ID NO: 19347 - DNA, 394 bp, Homo sapiens
accccgtctctactaataatacaaaaaattagccgggcatggtggcgcacgcctgtaatcccagctactcgggaggccgaggcaagagaattgcttgaacttgggaggtggaggttgcagtgagctgagatggcaccgctgtactccagcctgagtgacagagtgaaactgtgtctcaaaaaataaataaatgttacttgtcattcctgtcattcttcttactactgctgctgctagtggctattaccatttctactactatcccagagctgcccatggcactaaagctacacggtaaatgatcaaggagaagagtggtgcaaagataggagggcgagaaaaagctgtgagttgtttattttaagtatcttatttgataacttccctaacatta

SEQ ID NO: 19348 - DNA, 501 bp, Homo sapiens
cagttcagataaagattagagggttgattcaggtatcttattcctgaaatagtgatgtagcatgtggtacccaagaaaatatgcaacacttgtggaaaagggcatattgtgagctacgcttttaactttttattagacagatggaatgctctccaatattgattagctagatgaaaatgagaacagtttactacatggcacatttctaagttcagcattttgaatctgaatagtaacatgactgaattgaaagtgatggagccctgcagttagggacacgatgtctaatcttaggcattttatcttcaacattgtcccagttctcttgtgtagggaaaaggaaaaggcacagcatgacctcttccaaggacctcaaacctggccagtttagttggttataacatggtgacgatgaaaacagcatggtaaattcaggcctcctggagggccatgaacctgtctacatgtctgtttctctgtgttgatcagtggctgacagtt

SEQ ID NO: 19349 - DNA, 192 bp, Homo sapiens
gtgtcttcccacagattacttgttagctgcaagggaaaaagtagtaatttttcattggaaaagttggacaacaccttggctgggtgatcaaaattagcataaccaagctggggcagatagactttttgtgcctttagatgtgatatccagagaagaaaatatcacttttgtagttttctgagaatgcagaaa

SEQ ID NO: 19350 - DNA, 429 bp, Homo sapiens
acctttcctttcacccccaccattaaaaaaagaaaaacaaaacaaaacagagggaaatgtgatttaatggagtttaaaagggtagaggtatttcttcaggtcagtgacaggacattcacctccaaatctggaaagacgagttcaaaagcaagcagtgacttacctcataatgaattaattgtgtgcctgaactatgatccaaaaggccaggtgggcagacctttatgcactgatgagtagcctctctgtggcccagaacaaaaaatgcaaccctgatggctaacatgtggttttctgctgtattgcatttacagagatctatggtgtaattcattctcgataggtgaggagacagcggaatttagactaagactgtcagcaaattaatatcctagctttttagcactaaatgtttccacccaaactgga

SEQ ID NO: 19351 - DNA, 2261 bp, Homo sapiens
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19352 - DNA, 388 bp, Homo sapiens
  misc_feature (29)..(29): n is a, c, g, or t
  misc_feature (40)..(40): n is a, c, g, or t
  misc_feature (73)..(73): n is a, c, g, or t
tcttccttcagccaatctgaaggacccgnagacagatggnactgtccaacccattcccggggtctcatggaanctgggcaccctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19353 - DNA, 2711 bp, Homo sapiens
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggtgagggggctgggacttgggcaggaaggcatcctggaggaagggttcctgtggccagcaccctatgtggctaagggggcgggggatggctgggagacaaggccgccttttctcatcagctctggcactgtctggaggaaaggactcagttcggggctggactggcagtgaaggaagatggtgtaccctctccccttcactgacccttgatggccttctccctctttgcttggtctctctctctctctctgcctgtcctgggcacattgtctggctgtccatccaatgtctctgtctaaatgccctcctgccccctggcctcggggcccggaaacacctgccccctgtctcccacttctgcccaccggtttctgtctgcacctcggtgtgtcccactctcactctccctcttcctggcctgcctctccatcagtctctctgtctctccaggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19354 - DNA, 2460 bp, Homo sapiens
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggtgagggggctgggacttgggcaggaaggcatcctggaggaagggttcctgtggccagcacccctggcctcggggcccggaaacacctgccccctgtctcccacttctgcccaccggtttctgtctgcacctcggtgtgtcccactctcactctccctcttcctggcctgcctctccatcagtctctctgtctctccaggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19355 - DNA, 1896 bp, Homo sapiens
cgcactgggcccagatgatggttttgagacttctccagaaccgacacatcaagagggactgatttgcaggggaaggaggctaggaaaattgggaatcaaaaaaaaaaaatggtggttttgaaggaaaggtggagggccaggcggagggagacctgggatctcacaccgctttttccgtcccccctgacagtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19356 - DNA, 1705 bp, Homo sapiens
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19357 - DNA, 909 bp, Homo sapiens
ctagaggatcttaactgcatctgtgcctcctcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19358 - DNA, 473 bp, Homo sapiens
taggggaccggtgtggaagtggagagtggtcagaggagtagattttgtataggccaggttgtgacctgtagtgactagaacccttgtgatgtagtgtgaggagaagtggcagcccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaaca

SEQ ID NO: 19359 - DNA, 283 bp, Homo sapiens
caccctgggcaacatggtgaaaccctgtctctactaaaatacaaaaaattagccagacatggtggcatgcgcctgtagtctcagctactcaggaggccgaggcatgagaatcgtttgagctcaggaggcagaggttgcagtgagccaagatcacaccaccacactccagcttgggctacagagtgagactatgtctcaaaaaaaaaaagaacctctgttaaaggattccttttaatccttttcagaaccagtatttatgttttttttttaacactgaatttga

SEQ ID NO: 19360 - DNA, 417 bp, Homo sapiens
acgcctggattcaagagctcctgtcccctcagcctaccaaagtgctggtattaaaggtgagatccactatgcctggccacatatatacaacttataaataaaaataaccttatatacaaggttaaatgcaaatatcccacagtgaaggccgggcttcagcataaggaggaagtcctgcctgaaaaaggctgcggcttggaacattttaccctgttgtcatctggctacgagttggctcacatcttctctcattcagaacctgaaggggtggggcctggggccgtattatccaatcactagtgctggggtaaaaactgtcttaaaactattcttttaatgcttagcaatactaatttttagtgagaaacttaagattacttaatttaacataaccagactttaagattttaaattact

SEQ ID NO: 19361 - DNA, 825 bp, Homo sapiens
aagtgcacaggctcaggagcacattccgtcgcccacccccgggggacccagctatggaagtgtctcaacccttcctggccccctacgtgcacccggcttcatccttggcccccagggacggcggcccttcacctgcagacctcagcctcaccctgtataaagctctgtcttcctctgctgctacaagaacccactgcagatgcagcatcagccaggatgcttccacatccccccgcgggacctggggacctgggtgaatgatgaacacgcggaagctcacgtagcttgctgtgccgtgagtagtaagccctttgtctccgcctccggggtctcatgtcttcttccagggtccacgaaacaggaacgagttgttagcttgcaagagttaaaatcaaatcccccacactcgtgtattgggaggatgaaaacctagatgtggaattgctcagccaaagcacgggcgtttgtaatttcaatagttgttcccaaacctcccagcattagggttagagtccctcatcagttcctcctccccacgccccagcacatagtgtatttcagatattggtgattttaatttgcattcttgtatcataagtgaggtttaagagcgatttgcatttccttttctgtgaaccgtgtttacgccttttgctcatttttctagtagattgtttatgttttgtgcctcttgatttgtaagaacttggaaactagggaaattaatttttgaatgggtttcaaatactttaccccagttttgattttacatatagtgttctttgccatgcagaaaaaattaaatttgtatgagttgaaaaaaaa

SEQ ID NO: 19362 - DNA, 452 bp, Homo sapiens
aaaccaccagtattaaattttaaaaagaattattgtatgtaaatctttagctttcttttttgtgtgtcataaagacacggtccctctatgttgcccaggctggtctcgaactcttggcctctagtgatcctcccaccttgacctcccaaagtgccagggttacaggtgttgagccaccacacttgaccaatatctaacagttcttaaattaatgcatcattgtagaattgaatgttaaggctacactccactctatcagtctttttattgccacctaaaaatttcatttttgtttaatcttgctttggattttggttagtaaacttctagggatgtagtttcacattgataacctgttaacttgggagctatggagtatggaggtgtagtgaggaagtctggaaggggagtggaaacccctaggcagggattttctggaggggccagatggt

SEQ ID NO: 19363 - DNA, 525 bp, Homo sapiens
  misc_feature (461)..(461): n is a, c, g, or t
  misc_feature (476)..(476): n is a, c, g, or t
  misc_feature (494)..(494): n is a, c, g, or t
  misc_feature (522)..(522): n is a, c, g, or t
catctacggctcaacattttttgtagccacaggcttccacggacttcacgtcattattggctcaactttcctcactatcagcttcatcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaaactaatatttcactttacatccaaacatcactttggcttcgaagccgccgcctganactggcattttgtanatgtggtttgactatttntgtatgtctccatctattgatgagggtntta

SEQ ID NO: 19364 - DNA, 385 bp, Homo sapiens
ccaaaaaggcataatcaaactttacttcctctctttcttcttcccactcatcctaaccctactcctaatcacataacctattcccccgagcaatctcaattacaatatatacaccaacaaacaatgttcaaccagtaactactactaatcaacgcccataatcatacaaagcccccgcaccaataggatcctcccgaatcaaccctgacccctctccttcataaattattcagcttcctacactattaaagtttaccacaaccaccaccccatcatacacttccactccacaaccctcctcatactaggcctactaaccaacacactaaccatataccaatgatggcgcgatgtaacacgagaaagcacataccaaggccaccac

SEQ ID NO: 19365 - DNA, 399 bp, Homo sapiens
  misc_feature (330)..(330): n is a, c, g, or t
  misc_feature (334)..(334): n is a, c, g, or t
  misc_feature (338)..(338): n is a, c, g, or t
  misc_feature (354)..(354): n is a, c, g, or t
  misc_feature (359)..(359): n is a, c, g, or t
  misc_feature (390)..(391): n is a, c, g, or t
catctacggctcaacattttttgtagccacaggcttccacggacttcacgtcattattggctcaactttcctcactatcagcttcatcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacgtttcgacatancaangtanacacaggcttcccacngactncacgtcattaatggccctactcgagggtacnnagctcgag

SEQ ID NO: 19366 - DNA, 353 bp, Homo sapiens
gttaagaaatgtggataaagcttgtaagttagaaatggcaagataatcagctatatgaagaatctcagctgggtgttttggctcaggcctgtaatcccagcactttgggaggctgaggtgggtggcttacaaggtcaggagttcaagaccaccctggacaatatggtgaaaccctgtctctactaaaaatacaaaaattacccaagcatagtggtgggtgcctgtagtcccagctgcttgggaggctgaggcaggagaattcgttaaacctgggaggcataggttgcagtgagccgagattgcaccactgcactccagcctggtgacagagcgagactccgtctcaaaaaaaa

SEQ ID NO: 19367 - DNA, 1181 bp, Homo sapiens
tgccaatgtgttcctggttgcgtttagcccagacgccctgcggccgctttgcctgaccaaagtctgtgggcgtggaacaggccctgggttctcctactgggaagaatgaagttcaggtactccatgtgatatatggttccacaatcctcagcgtgttaactgaagccttgttgagtttaacaaagctgccattgaagatctggggaaagtgaagaagttgcaacagagttttgggctcacaccattgatacatttgatccttaaggcccaccccgcctcactcccaccctcttctacttaattcaggatgtgaatagcacatgccttccatcttcagacaaacactgaggcctggacaatgacctgcattaggtagatagaatctactgaaagctaaaagccttttcctgtgtcttagcagcacggaagccacgcctccttccccccaatgtttgtgcaaaccctagagaagaggagacagcccctatgatgtgtgaggttgaatttcctgccctcaacccatcaaatcaggcagaatgagggctcagtcagaactacaactacaaaagagaaaaattttaatgtgacttttcttgtctgctcagatttttgggttaaggttcatgccagctacattctttgcataataaaatataaatagagtataaattgttctagttagagaaaacagcaaaacagtgctctcccaagggccctaataaatcactttacagaaacgtggatgtgtgttggatttacaggatttctatgccaagcagagaagtacgtgaaaacaggaaagcaaaatgcataagttgcaataatagttttgtggtttagctgaataatgtcctatatcaacagaggataatgattttagtttttcagttgccccaagatcatttccattactgatgaggcttgaaatgtctgtgaagaagagtcattgcaattgatttatttgtctggcaaactttttgtcagcaaattcaccactacctcaaaaatctcactagctactctatgcttaagacattggaagcataagccacaatgaaaactaactcttagcattagaattctaagaagcagtaatgtatttatgattttatgttaaaaatctcccagatgtcagcatttaaatcacaattcagtaatataagtaatttgaaattagaaag

SEQ ID NO: 19368 - DNA, 1427 bp, Homo sapiens
aaagtaagggactattatgatctgtaccccaccccgacgcacgccaagcggctttttccccatttgtggccaaatttcccggcatggggaaggagccttaggggaagcacccgggacctccttggcttcttctgggagtctagtttcacctatttcgtttcgccaacaggcgagacgggcaagacttcgggctcagctgccaccatcagtactgacctgtccatggctaaagccttttccacacacaaccaaagttggctgcagtttagctaccgcgttttagccttcccgctctccggaagcaagcccttcgacccggaagcagtctgtccctaaaacagacccacagaaaaggggttcaggtactccatgtgatatatggttccacaatcctcagcgtgttaactgaagccttgttgagtttaacaaagctgccattgaagatctggggaaagtgaagaagttgcaacagagttttgggctcacaccattgatacatttgatccttaaggcccaccccgcctcactcccaccctcttctacttaattcaggatgtgaatagcacatgccttccatcttcagacaaacactgaggcctggacaatgacctgcattaggtagatagaatctactgaaagctaaaagccttttcctgtgtcttagcagcacggaagccacgcctccttccccccaatgtttgtgcaaaccctagagaagaggagacagcccctatgatgtgtgaggttgaatttcctgccctcaacccatcaaatcaggcagaatgagggctcagtcagaactacaactacaaaagagaaaaattttaatgtgacttttcttgtctgctcagatttttgggttaaggttcatgccagctacattctttgcataataaaatataaatagagtataaattgttctagttagagaaaacagcaaaacagtgctctcccaagggccctaataaatcactttacagaaacgtggatgtgtgttggatttacaggatttctatgccaagcagagaagtacgtgaaaacaggaaagcaaaatgcataagttgcaataatagttttgtggtttagctgaataatgtcctatatcaacagaggataatgattttagtttttcagttgccccaagatcatttccattactgatgaggcttgaaatgtctgtgaagaagagtcattgcaattgatttatttgtctggcaaactttttgtcagcaaattcaccactacctcaaaaatctcactagctactctatgcttaagacattggaagcataagccacaatgaaaactaactcttagcattagaattctaagaagcagtaatgtatttatgattttatgttaaaaatctcccagatgtcagcatttaaatcacaattcagtaatataagtaatttgaaattagaaag

SEQ ID NO: 19369 - DNA, 342 bp, Homo sapiens
gcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttttcctt

SEQ ID NO: 19370 - DNA, 4193 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggaaattttggcaccaccattttgctgctcctaagtcagacttgtccaccctcagaacactgaagacccaagtgttgagcccaggctactggaaggggttgtcctctgcatggccctccctcaacctgtgtctttcccgtgagtgtagggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19371 - DNA, 4047 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19372 - DNA, 4112 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatagggtctccctatgttgcc

SEQ ID NO: 19373 - DNA, 4018 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19374 - DNA, 3974 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttacttctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19375 - DNA, 3953 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19376 - DNA, 3944 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatggccactcaataccgggtaccgagct

SEQ ID NO: 19377 - DNA, 2181 bp, Homo sapiens
aaagaaaaatggctatggatcgaggtcccctaggggttttattttggcacgtaggcacaggccggatcactcggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 19378 - DNA, 2417 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcacctcaaagagaagcccggtgactgcagtcagtgtggaaatgcatccgggacccctctcggcccctgaaaatccacatgcgagttcacactggcgagagcccttacaagtgtgatcagtgcgggaaggcttacggccggagctgccacctcatcgcacacaagaggacgcgccatcgtgcgcttcgcattaggcaataacgcgcggaaatcatgactgcggcgttcgtggtggtggtgatcggcggcctcggcagtttctggggcgtggtactggcagccttgctggtcggcgtggtgcgcggcattaccgtgcagttctatgcgccggcaggtgaagcatcaatgtatctgctgatgttgctggtattgatcttccgtccgcgcgttattgcctaatgc

SEQ ID NO: 19379 - DNA, 1171 bp, Homo sapiens
  misc_feature (3)..(3): n is a, c, g, or t
  misc_feature (9)..(9): n is a, c, g, or t
ggnaccatnactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatagggtctccctatgttgcc

SEQ ID NO: 19380 - DNA, 710 bp, Homo sapiens
tggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtgtaagccctgctttccttaacccttctccccctcagttccaggggtcacgggaggcctatctggcggtgaggactaagagggtacgagggtcgggggctaaagagctaggcatccagacgaggggtgcgtttagatctcgcgatcagcgatatgaaaagctggggacgcgaaggataaaattggaccattgcagctagtgatgagagaagcattggtcacctgatcctgaaaagccctaagtctctggtgggggcggaaaagcccggctgaagtgaattcaagagtttgggggcagttcaggagattggggggcgtcaggatttggacatcgcgaggagaaatcaccttctttctgcgctgtagtcaattttatctcgtgaatgtcagcacattggtgttcttattagcacttaccttgagtaccttttatatttttaatttaagaccttctggttgcacttttttatttattttaattttagtggactcttgtaaatagcctatatgtatatttactattcagttcaacattttgtt

SEQ ID NO: 19381 - DNA, 397 bp, Homo sapiens
gttcttcccttttgcctcttcttactactctctctctgcagctcattcctctttgctactctttacggtgaattctaatggccctcgcactctcagctcagggagtatactgggtcctgcctggtgtccagctccctgtgctgtggcctggaaactctttcaggccatgagctgttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccatgctttccaggtcttccataaaccattctgttctttc

SEQ ID NO: 19382 - DNA, 280 bp, Homo sapiens
tatttgttgagagatgagtgtgatctgttatatggataatttttataaatgtataatgtgtacatgaaaggaatgttgattattaacatttcattttatattccactcctttgtatgtagtttcctccacacatcatttaatctctttcagtaagaatcaattaatatcagtttttcatctgcaaatgtacttattttattcttcaatgtagtttagctggaaaccccatttctaccaaaaatacaaacagattagccgggcatggtgttgtgtacctcc

SEQ ID NO: 19383 - DNA, 638 bp, Homo sapiens
attcaggaactggtgacccaatttgggagaggctaaggatacttttcttatttcctgttggcctttggttgttgtacacttctaacatcttaggtttcttcttttagtttatattgaaaactttaaaagttaacatagtatgtattagaaaattaaactgtaaatatacagttattactgttgtctttttaaataattcttatcctcagtggtatcacttatacttgaatatcttttgcttaacgctggagaaaaactgtgaccagtttttaccaattaaaatcacatctcattacaatttcagtcttgtattaaatttgaggcagtgtgttataatgtaattaattgaagctgttacagtcaaacctgtattcaaagtccagccagtgttttttcttctgtaaaattgtgataatagtcataggcaaattccttattacctggtaaagaaagcttctctttctgaatcctgttttccctaaaaccagaaatataatttttaataatttttttctatagagacagggtctcactctgtcacctaggctggaatacagtgacaggatcataactcattgcagcctcagcctcccaggctaaagtattcttctgcctcagcctcccaagtagctgggacc

SEQ ID NO: 19384 - DNA, 1699 bp, Homo sapiens
taaagtgaggtgatccagtcggtaaacgctttgaaaaagaatagctgtcccctgagcgggcattagtcgcgtgtgaggtcagggcccatcattgcgcgtgttgggagcgccgcgctggtctatgagcgagcgcctcggcttgtggctgggccgggccggggcggggctgtcttcccgcggagcgtgctgggggcgggtcgcgccgggccgggccgctagtgcgcatgggcgggcgtcctcggctctaactgccgccactttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccagatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggataccaaaataaggga

SEQ ID NO: 19385 - DNA, 201 bp, Homo sapiens
atgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagct

SEQ ID NO: 19386 - DNA, 450 bp, Homo sapiens
acaaaagtggcaaacaacccatatttccattaactggtgagtggataaagtgtggtatatgcatagatgataatattattatgcaataaaaatgtttattatgcaataaaaaggacgcactgctacagcatggatatgccttgaaaacattagtgaggggagtcagtcacaaaggaacacattgtatgacttcatttataggaaatgtctggaataggcaaattcatagagacaaactagtttcctagactggtgggcagggggatggggaggagttggggaggaatagggagtgactgctaatgggtacagggtttatttggggagtgacgaaaatgttctaaaattgactgtggtgatagctacacaactctcaatatactgaaaactatttgaatgtactctattttttaaaaattatttttgtggtaaaatacataaagtttgcca

SEQ ID NO: 19387 - DNA, 475 bp, Homo sapiens
atcatgaagcattcaaataaagggaagtagagattctgttgagaatataatgaaatatctcttgttcttttgcttttaagaagcttattattagaaaactgggaacactttaacacatggaaaggtatagccatactggaaatgtcccaaggaagtttgtgacaaatgaccaaatctttttcagttttaaatgttttgagatgcaagattatatgtatttaggggaaaggaaaagggggacagtggtagagataaagcaaatggagtggaacgtgagctgggtcagaaaaaaaaaatgagtacaggccatttcaggcattgaacatcggtaggggagcagatgattcaggtgcaaagaaaatcactccagcactttgttctgagaaaaaatccacagtcagtgcagcttggttaaaaacaggaatgttcaaagaggtaccagtcttgtaggaatcaaatgctcatatgtatgaat

SEQ ID NO: 19388 - DNA, 166 bp, Homo sapiens
cttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaag

SEQ ID NO: 19389 - DNA, 367 bp, Homo sapiens
ttttgagatggagttttgctcttgtctcccaggctggagtgcagtggcgcgatctcggctcactgcaacctccgcctcctgggttcaagcgactctgctgcctcagcctcccttgtagctgggattacaggcacccaccaccatccctggctaattttttgtattttcagtagagacagggtttcaccatgttggacaggctggtcttgaactcctgacctcaggtgatccactcgcctcggcctcccaaagtgctgtgattacaggcatgagacaccatgccccgccagtacatgccttttaattccatagaaataactttagaaccttgaggcactgtgttgttagtactgcagctccttcaagt

SEQ ID NO: 19390 - DNA, 632 bp, Homo sapiens
ttacattagaaattttgctatcaggttcaatttagcaaataaggctaagaaaagtttttgtcttgtctatttgcaagcctgagtgatgtagatatttataagcatggctttataatattttacttaatgggaaaaaaatctatgctaattgtatttccaatccaataaagtgaaatttgtctagcagcagggtgtggccagagtaaatagaccgtaaggaaaacactcacgaaggagtgggaatggtatttctgaaaccccactggacaacaataattattaacaatttatctcaagcttgctcctctcttagtggcatttttttaagtcgtttccttcctagaagtctttgagcctagaaaagccaagttttgtgtttatttctttcacatacattaatgtcttgagtcagatatcactaatttgaaaatgggtttcatcctttttggtgaaaataatttggagttcaaccaggttggtacctgggtacctggtactgtcccctcaggtgtcatatgactaatcatgaaagtcctttggttcacggttcacaaccttttcatagacagatattatgtagcaagttaaccttaaggacacataccttaaaggactgttgagcaaaaaaaaaa

SEQ ID NO: 19391 - DNA, 217 bp, Homo sapiens
tttgaaaccagcctcggcaacatggcaaaactccatctctacaaaaaaaaaaaaaaaaaaaaaaaaaattagctggacatggcagcacatgcctgtggtccccgctacttgggaggctgaggtgaaagcatcaccttagcctggaaggtcgaggttacagagagccaagatcacagcactgtatttcagcctggggggacggagtgaaaccctgcct

SEQ ID NO: 19392 - DNA, 315 bp, Homo sapiens
gctggtgggagtccgtgctccccggggctggccagagatgcaggactgagccccatctttcacccctgccaagcgagccccaggccctcttctcccggccagccggcctcctgtccttgcggcctgagtacactctgatcactgtctctgttccctgtctccctcaaccccgccttctcctgctcctggcttctccggctctcagaggaagcccaggaggaagaggaagttcaagaagaggagaaccgagaccaaactcactgctcctaagatccagagggagaaagtggacttcgatgacatccagaagagcgt

SEQ ID NO: 19393 - DNA, 86 bp, Homo sapiens
cctgggctttgtgactttggttagtgccactaccttcttccctcctttcccccttcaatttggaaataaatttctgtatatgttgc

SEQ ID NO: 19394 - DNA, 434 bp, Homo sapiens
cttgaggggatgcaccagaagcaaggaagtaactgttgacaaagtgagacgggccacaaagtagagcttttcttgacatctgatggcagcacaatagtaagctgcaccgcttctgtggacattgcagatgaacacataaaacctctccctcaaccagatcctgtacgtgacaatgaagaaacacatgctcaagtgctgaaaaatagattagcaaaaaaaagaagtttgacataacccaagacaacatgttcgttaaatttcatagatgcaaaagagagaatgcttctgttgcaaaacatagaagtcttctgcaagcagctgccacgcccatatctcagagccctagtgagttgtagagaagtttcaagagttagagtatttcctctgtacagtaactaaaataataaaagaccacaatttttattcataaaaat

SEQ ID NO: 19395 - DNA, 362 bp, Homo sapiens
cttgaggggatgcaccagaagcaaggaagtaactgttgacaaagtgagacggaatagaagaaaaagatggaaagagtcagaaagaacagaaacattgatattcaaccatttgaaacaagaaagaaactctaagcacagaaggcaaagagaagtttgacataacccaagacaacatgttcgttaaatttcatagatgcaaaagagagaatgcttctgttgcaaaacatagaagtcttctgcaagcagctgccacgcccatatctcagagccctagtgagttgtagagaagtttcaagagttagagtatttcctctgtacagtaactaaaataataaaagaccacaatttttattcataaaaat

SEQ ID NO: 19396 - DNA, 424 bp, Homo sapiens
tgtgagtatgtgtgtgtctgtgtgtgtgcacatcatgtattgtagactctgctgttataagatttagtatttacagcgtcctttgttaaggggacctgactccactttattcaaggtgttctggaattttgaactatcccttgtcagaaaattaggtgacagatcctgactctattgtgttaattcaaagaatatttctgttttccagaatcatcatttttgttcttttttcttgatttgtgcttgacttttttttccttttctactattccgatgatcatataacactttagtatgatgctcattaatttcacttacaggaatggcatggccacatagtctcaaaaaatctatgcaggtcaaaccaacccattctgataactgctctggccctgctggaactacagaaactgcctctttgtct

SEQ ID NO: 19397 - DNA, 436 bp, Homo sapiens
gcctgcaccttatgtgtgtgtgttggtgttaggctggtgaaataatgtcgtgcagctagtaagccttccatccttttgacatactgcatataatattatgatccagatcccaatccagattctaactgtccttcaagtctcaccttttccactaatgcagtgacagtgggaaaatcacagaactcagctcaactggataactgcctcttctcagtaagcctgcggtattgggtcgaacagtaggaaacagacttttgtttcttttaacacagctgaatagtggccagttttctatgactcagcgcactttgcccctggttcggcagatagtcccctgtttgctgttgttggtttatgcaggggctctcagcctggctgcacattacaatcaccctgggagcttttaaacacaacccaccgagccctatgcagtctc

SEQ ID NO: 19398 - DNA, 219 bp, Homo sapiens
cataagttttcacttcttttttctgctagaactattaagttcacagggctcagacagagacttgaggactcttacagttattgattgtgactgcacaagatgagggtaatgtttatttgtcattataaatctggaaagataaaccctgtgctttccctgttaaggggctggataggaatacgtgttcagcaagtcagtaaaaaaaaaaaaaaaaaattg

SEQ ID NO: 19399 - DNA, 436 bp, Homo sapiens
tccacttaggatgtagaatactgcaagaaaatgtcccttccgtcctaacaatgtgaaaaagcaggtacaaaatcataacttttcttgagcccatcagaaagccaaggccacaaggcaaccaaataaaggagagatagtgttaggggagctgagttcatagaaatgaataggagtgagaggaaatagaaggagagatagtgacccatcaactgtttcaactttggcaaagatgtggctgtcttacaagtgggtaagaaaaagacaataaaaatgttaacaaatttgtaaagtccacatgtggcctagcatatcagtttagaatagctgaataggattctagacacgagagtgcgtgcaaaggcaaccttttttgtacaggcctcccctggggttcatggagaaaagtgggaacaggtcaggaaagggagggactgtt

SEQ ID NO: 19400 - DNA, 228 bp, Homo sapiens
tccatattgtagcatgtgtcagaatttcccttcctttaattcttttaaagctgaaaataacattctattttatgtgtatgctacattttgtttctccattcatcccccaatggtcactgggattatcttcacattttgttgctgtgaataacgctgctatgaatatgtgtgcaaatatttgatttttggggtatatacccagaagtggaactgctggatcttacaata

SEQ ID NO: 19401 - DNA, 1748 bp, Homo sapiens
agctttgcgcagtggcagtatcgtagccaatgaggtttatccgaggcgcgattattgctaattgaaaacttttcccaataccccgccatgacgacttgaaatatagtcggcattggcaatttttgacagtctctacggagactgcatgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19402 - DNA, 3613 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19403 - DNA, 3431 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19404 - DNA, 3095 bp, Homo sapiens
  misc_feature (18)..(18): n is a, c, g, or t
  misc_feature (20)..(20): n is a, c, g, or t
tgatgtttccgtagggcngntagagccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19405 - DNA, 2894 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19406 - DNA, 3660 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttcagaatgtgtttattgggccctgggcttaggcacagggtca

SEQ ID NO: 19407 - DNA, 1915 bp, Homo sapiens
agggatcatttagtggaaaatgttcccagtggaaaatgttcagggaagtctttgggccaggaaaatagggtgtatctcatgccacactcacagctctgtctctggggcagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19408 - DNA, 3530 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatatctcatttcatcactcagctgatctgttgccttacccaagattgccgtaggccgtttgcttgaatggaagtccttcacttagctaactacggtctaattggacggccggtcgtcccggcggaccgaagtgcggggtggggcacaacaaggagcaaacacggcgttcgctgttatttttc

SEQ ID NO: 19409 - DNA, 3349 bp, Homo sapiens
  misc_feature (3328)..(3329): n is a, c, g, or t
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaaccctaatacgcagacgcgcctnntgggatcctcgcgaacgctc

SEQ ID NO: 19410 - DNA, 1859 bp, Homo sapiens
tctcctaacttcccttatgtcccagccatcatttgggtctcagctgagacaccattttccacaggatgcctcctctggcctccaaggctggttaggtgttgtcttgatgcttttacagctcttgtactgacaccctcattccctgctgcctccatggggactgccttgcctggctgtctctgcttccctgtgagcatcttgtggaaagacagggactatctccacagtgaaaaggttacctccctgcctctctccaacccctaggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19411 - DNA, 3314 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacgcactcagtagcggtcgttttcctcaagagtcagcgatt

SEQ ID NO: 19412 - DNA, 3303 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacagtagcgaacgggtaccgagcttgctagtg

SEQ ID NO: 19413 - DNA, 3162 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggcaagtattgtctgtgtcccctctggaatgtcagctcctcgagggcagggattttatctgttttgttttctgtgatcttcagttcctagaagagtgtttgcacacagtagcaacggtccga

SEQ ID NO: 19414 - DNA, 1277 bp, Homo sapiens
tcggctaggtacaggccgcgtgtcaaatcggccgaggagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19415 - DNA, 823 bp, Homo sapiens
aacgaccgctactgtatccggcttcattagcatcacttttcccgaacatagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattca

SEQ ID NO: 19416 - DNA, 2570 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcagtagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacaactccatgaaaagaagttcttgcataccggaaagttgaataaatggatgaattcattccttcagaatgtgtttattgggccctgggcttaggcacagggtca

SEQ ID NO: 19417 - DNA, 2290 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtgagtagccttatccacacccccgtccgatcagccctggcccttggaaggaaaggccagccaaacctgggcagctcagggtgagaagacagtggggagtgtttgtcacacaggtcctggccctgcctggttttgtgtggaagcagctttctggtgaggaggtgagctggagcaaggacttcccagctgtggactctgtgctggtgagtaggacctggaaccagtgtttcctctgcccagcccctaaaggttggtcctccctaaggctgttctgtaccttgttctttcaccacacacaagatccctctccaatccatccactcccatggcttcaactactgtctgtagactcgtgaccccta

SEQ ID NO: 19418 - DNA, 2015 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtttgcgtgggccacggtggtgaggggtccatttcctgtgcatttcatctggggctgtcactccttcttcagtgaggcagctgagag

SEQ ID NO: 19419 - DNA, 1244 bp, Homo sapiens
cggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggtgcgctcttccctgcccaggacccggtaaaagacccctggggccagagaaacctctggctgtttgccttttctcccctgtattgagttggcattgcgttcggcgccctttgccctgggctgggcacgacaggcggctgggcagttccctgacggctgtccccatcctacgcgtcccggcaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgaggtgaggtttaaggctataaggagggaaagagagcccggcgtggagatgggggcaaacagagagtgtgtgtggagagaagaggatgggct

SEQ ID NO: 19420 - DNA, 297 bp, Homo sapiens
gcccctcctgagccccagctcctgggacccagaacacagcctgtaagccaccagtactccaagaactctggcccccaccattcctcagtgccacctttctgctgctaaaaggccacagtgatgccccccagtgtgaggcgggaggtgtgccctcttccccagccaagcctttttacccactccccaggtggcagctatgcaggcaggtctgctgaaggtggtaccacaggctgtgctggacttgctgacctggcaagagttggagaagaaagtgtgtggggatccagaggtcactgt

SEQ ID NO: 19421 - DNA, 247 bp, Homo sapiens
gttgtagaccctccctcaccatccatgcaggcactgatttccttctccctccagaggaccggagccgcttcctgcgctttgtcacgggccgcagtcgcctgccagcacggatctacatctacccagacaagctggggtgagtgctggagggaggcctgaaggtgccatggccgccttctgtcctccctccccacacacgtacatgtgccccaacacatcttcctgacctatggtccctcaatgcccc

SEQ ID NO: 19422 - DNA, 869 bp, Homo sapiens
gtctgggggaagcagagagtggaaccacatagttcagcaggaaagcctcagttcattaattccaagcaaatctagtaaatggcttcctaccataggctgtgattgcttcagaggagaataaaggaaggttaatcaatggccattttaaaaaatctgaaaaatagatttgactgctaataaaatttagattaaatagtttatttctgaatattccacatcgggtatattacatctgcacatcttagatctgatgcaaagccacactaaatggcttctgtgactaaatagaatccaccttgcatttattggtattgctttattttaaagcattctttaaatcatctatacaatgataaatggtgaaatattacagctttcatgtgcgattaacttaaggagtcttgaattcgtttccattgatgcctcaatcataaaatagggatatcctcttttaaaaccgaggatagaactttgttgtgtttgggccaaatgctgttgcaaaatcccccaagcaagaagatttacaggcaaaaatgttgtagacatgacaaagttagaagtatatttagagtatgagattatgtaatacatcattctataggtttaactgttgtgagttttttcagccacaaagggttaaaatgaaaaaatcgaaatgttatgtctttgttgaaacaaataatttactttcactgaaaatattattgaaaaaataatcataaggatctaatgacagtgccaaaatatagaaaacaaaagttaccatggaaggtgctgtggcttaagaacatcacagctatgatcatatagtggttagtactctgtgttgtgcctgcagcaacctcagttgtatccaagttgtggcacca

SEQ ID NO: 19423 - DNA, 296 bp, Homo sapiens
gtctcaaaaaaagaaaaagaaaagaaaagaaaaaaaaagagtataaaggggttctaaatccaaaaagttaagaactgcagccactgaacattactttgggctaattggtccagaggaataataattaataacaccaaaattcaccaaaatgggaaatatcatgtgtggttttagataaaggaccagagtaaaagtttcaaacctacaaactagcccactgtttaaaaggtgagattacaattttcacctattaaatatgccaatttgtgaaagtatagagagaaaggcagtcatgg

SEQ ID NO: 19424 - DNA, 447 bp, Homo sapiens
ggcttttttttttgcagaaattgacaagatgatcctaaaattaataaggaaatcaagaaacccacaatagacacaatagttttgaaaaataagaacaaagttggaggcctcacatttcctgatttcaaaacgtattagtagcctacagtaatcaaaacagtgtgggttttgacataaaggcagacatatagaccaatgaaatagaatagagtccagaaaaaaaaaccctcacatatataatatatgatcaattgatttttgacaagtgtgccaagaaaattcaatgggagaaagaatagtttgttaaaaactgatgctaggacaactggagatccacatacaaaggaaagaagtgggattcttactcccccaccccctccccccaaaaaaaggaaagaaaaaaagaccttaaattttaccatggaccttgacataatagctaaatat

SEQ ID NO: 19425 - DNA, 458 bp, Homo sapiens
ttgagaaatactatcacctctgtgtgggtgtgcatttgtactgtatggcaggctctgtgcatttaatatatatgatatcctttaaccctcaatgcaaccttgcaaggtagatattaacgtccacatttttcagatgtggaaactaagcctgagcaagttttaaaatggtctctaaattcacacggctgcaggaactactaggtgaaataggctgaatgtaaacacaggtttaacgctaaatcccatgttactcccctcaacttttccccatttaaggaccttatattgagggtttattctgagccaggctgtatgctaagactttacgccatttgtccttatttacctgtgaagtcaatacggtcattatctccattttacaaatgaggaaactgacttgtaaagtggttagtcatatgcccaaggccacaaaactaataaagtgggaaaccttacca

SEQ ID NO: 19426 - DNA, 352 bp, Homo sapiens
tttatatttgttatagattcttatcagaagacactcagggttctacagattttagatgaagatgcacagctctccaacattaaaattactgagtctagcatagtgtgcaaagaaagctagttattttatgcctaataccatacagaaaattctaggccgggcatggtggctcacacccgtaattccagcactttggaaggctgaggcgggtggatcacttgaggccaggagtttgagaccagcctggccaacatagtgaaacccctttctgggaaaatacaaaaattagctgggtgtggtgatgtgtgcctgtagtcccagcttgggacccgaggtgggaggatgacttgag

SEQ ID NO: 19427 - DNA, 437 bp, Homo sapiens
tatcaacatatggtactaggcagggatgatgtaaataatgcaatcaacagatcttgggagaattacttactgactcaagattggccaccacgcctggccaaaagggactttaaaaagctttgttgcaatttctaaaacatcataaggatatatttccaaaaattttcacatacttcatttctatctcttttttctctgtccttgccttcctcacaaactcagcctagtatagtgattaaaagcgtgggttttagaatcagtatgacattgcgtagagctcaggctacattattgactaccaacatcaccttgggcaaattactagtcttgaggattatcctgctttgtctctaaacttcacttaatagggtatagtactgtttgtgaaaagtaattgaaattgtgtaaataatttagcagtacctggcacatacatg

SEQ ID NO: 19428 - DNA, 407 bp, Homo sapiens
tatcaacatatggtactaggcagggatgatgtaaataatgcaatcaacagatcttgggagaattacttactgactcaagattggccaccacgcctggccaaaagggactttaaaaagctttgttgcaatttctaaaacatcataaggatatatttccaaaaattttcacatacttcatttctatctcttttttctctgtccttgccttcctcacaaactcagcctaggcgacagaacaagactctgtctcaaagaaacaaacaaactgcatgcatagagaactttccagggatatgtctgtcatgctaaatataatgattccagatagcactaatagttttttaaggttttcttttcaaaggttaattctttcctttcaggtttaggtaaagaggaacttaaggaag

SEQ ID NO: 19429 - DNA, 751 bp, Homo sapiens
aaatcccctaaagcacttccttgaagtagagatatgccatctgtgcaatcatacagcattttaccttctctttgcttagctttaaatggctcccagttttggaagccacaggcttctccaatcaactgtatatttctccagtaaagcatattcaggaaagttgactagttgattcttatcctgattgtttctcagctttgcttccttctttaaagaaatgtactcagaagaaaatatcataaattacactaacattgttttattattattaaactagaagcaacatactatttgtcccaggtcagagttcacattttcataatcaatagaatcagatgttgggatgaatatgacattattcttagtttcatatttcatggattcagtatatagaaaccacaaatttcctaagtttactctcccaaagacaatttaataaaccaaaaatgctaccaaaagagttcaagtgtgattgatgaagtattgacaatcaaaattaacaataactgacaaaacttaactttctgcagagactattacttaaaagtgtaattcagagatttggataaagaaatgatctctttcaaaagttaatatttctatactactttagactgtatactacctaattctgacatttatgtattattttatagttttcaaaatgttttcacatacattacatttgatcctttcaacaatttaaattcagctttactaacagagaagtagatatccatcatcgacctgt

SEQ ID NO: 19430 - DNA, 466 bp, Homo sapiens
ccacatcacacaggcttggctgggggaatagttgttactgcagccattggctataaaacagtttaacattcccctacatgcaccacctcccccattgtaaattgttgcattatgatcagcatacttgaacccaaatttgtgttaaattaaatgtttgatggtttccttagtttagattcctttcagtgtacttaccagtcaaagaagatgaagctttagaaggcccaaaggtcgttcagttgggattacagacatgagccactcaggccctgcctaattttgcatttctttagttgcttgtaagattgagcatggttagcatatttatggcttacctggctgtagtgcgtgtgtgaatgaagcagtcttattttcaagccacttttcatttgggcagctaaacagtttcttgaatcatcttcagttgtctttgggttactcttgactgaacaaaggcagaggggag

SEQ ID NO: 19431 - DNA, 303 bp, Homo sapiens
gattttcatgattccttgctgtgctgactgctcttacattcttctcaaaagaatattttagtttaacaaataatttaatgttgattccattttccacatggatttagtgtttaggcctgttttgtccgactgaaggacagactacattatcagggcttttctaatgaaagtgtatgtaggcagttaggtgctactgcgtgtgagaacagcagacgctaggtggcagcatcttgcttcggaactggcacaacaaactgggcgctgagttcatagctgcattttagagagcagggtcaaaggacc

SEQ ID NO: 19432 - DNA, 445 bp, Homo sapiens
gagcttctagctactgtgatcatcactggagtgcatccttctggcagggatatggaaaaaatatattcatgctaagcttttctctgaagagaaaagacttggaattctctggttgatgagaaaggacccttaagctgtgataggacctatgtgtaaagtttgcctggtcttcatgctctaatgactcctgtgatcagtgccagagtgaactgatggaaaatgtgtggttctttttcccttttgtgagctgtgagcctcagtattaccctacagctatatgaatatcagtgctttcattggaaggacagttgttcagatttgtttaagcttaaagtcttaagtttcaaacccttctcaaaaagtctcattcctcagtatcttttcacactgtatattgaagaatttcttcattttgatcttgttttagtttgtccctgtagtaatg

SEQ ID NO: 19433 - DNA, 1072 bp, Homo sapiens
aggactcaaaaggcttgtagcatggccaccccgtgggctgggttggtggaaagcctgggatattgctctggggcaagaggggcagaaggaagcgcaaatgaaaagccagactcctttcctaccagactccactgtcagatccctctccaactcttcctgtgtgggatgatggcatttttcacagaagaagggggacatgttgatatggcctacaaggtagacatcttcactcatctctcaccctaaagtggctgtgcccaagcagctgccatgctctgcccctctttccaccgcagtgccacacagtgacctatctccatcactggcctatttcagtgttgcccactttaaggcctaactccgagtacccttcctcatctagccttgacttcctaggccagtcccaagcactgtgagctctacaagctgcaggggctctgtggttatgcacctgggctttggaatcagacctgaccttgaaactgttttttaactgcatgactttagatatgctactcaagttctttaaagagactgtaattgtatctatttcatagggttgtgaagctttaataagaaaatacttgtaaagcacttgtataataaatgttcaacacgggttggtattgttggatatgggccatatgaactggctgagacttacactgtgtgtgccttgtgctgttagttgacactttagttcttctgtgccttgtgctgttaatcgacatcttagttcttccacatcctatttcttcagttgggttacaatattcttaaggcagggacctatcttaactgtcctctcacagcagggacttgtgccaagtaggaatatttgattaatggattcattagctaatcacactttgtagatgctttttgaggaacagaacttttgaatgcacgataaacttgggttctcgtctgaataccatggctttgaggttggttatatggagcctttcagtgtgaatccctaagcctcttgagatttcttgagaggcagatatgcctgcatagcctgccctgcctgatacttcacagaatgggctgctactttttacttatt

SEQ ID NO: 19434 - DNA, 564 bp, Homo sapiens
agtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagcccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatctt

SEQ ID NO: 19435 - DNA, 425 bp, Homo sapiens
tcagctgtggaataaccacagctaagccactagaccccatttgaaaaaaaggaaaatggaaccacaagagaatgaagtcaggtttttcagaaaggtctcaatctaccagctggtcttttggctgctgccctgcctaaaagcagctttcagaatgcttagaatttccctggatttacggtcctaatcctttatatggtactttccaatagcttccatccttacaaaggtttttgtttacgtttactgattaaaaagaaagaaaatgctgcccatgggtatcattgtgtcacctcctaagaaggcacaaggaagataattctacccattttagagatggaaaaaccaaggtgtgaagtatatctttttctgttttaatcataatcaaggttgggcttgcattcaggaccttacgttagtctcctagc

SEQ ID NO: 19436 - DNA, 194 bp, Homo sapiens
aacactttgattttaggacttctcacttccagagctgtaagacaataaatttatgttgttttaagccagaaactttatgataatttgtagcagcagcagcagcaatagcatactaatatagtccttcaaaaattgaattaatcatcttgcagaatcaaggggaagaactattttgtgtcacacaccaaaagtac

SEQ ID NO: 19437 - DNA, 1049 bp, Homo sapiens
gtggtgcaggcctgtaattccagctactcagaaggctgatgtgagagaagtgcttgaacccaggaggcgcaggagtgcagtgccactgcactccagcctgggcaacagagtgagactccatctcaaaaataaaaaaaaataaaaaaataaaagaagaagaaagaaagagagaacgagaaaggagaagggagggaggcaggaaggaaggaaggaaggagagagagagagagaaactgccctttgggtagcatggcatatgccgcttctcctgttcgcagtcagatcttcctccctttatgtaaagagtctattcttaccactgctgacatctaaagagcacagaagcaagaattacagcttagagaagttctgcaagatagaagtaacaagggaagacagaagattgtctactctggggagttttctgctttagtgttcacaaaacatttcataatctgcagataaatgtgcaggctctgcaaaatagaacatgcaaatagttcttggtaaaatctatggatcaaagctatttctctttgcccttcaaatgatctagtttgctttttaaatatttgaacattttcctacaagttgtgacaatgacacaagtttaaacacaccatgccttttataaatagatcctaacctgaaaaagcttccaccctgactgactcttgtctgaggtttgagaggaaaagagagatttaaagggaagctaattaatacaaatcttctaaaacatacatgaggctaggaatatattaagtgcttaattaaaaaacaatgtaatcccagcactttgggaggccgaggcgggcggatcacgaggtcaggagatcgagaccatcctggcgaacacggtgaaaccccgtctctactaaaaatacaaaaaaaatttagccgggcgtggtggcaggcgcctgtagtcccagctactcgggaggctgaggcaggagaatggtgtgaacccggggggcggagcttgcggtgagccgtgaccgcgccactgcactcctgcctgggagacagcgagactccatctcaaaaaa

SEQ ID NO: 19438 - DNA, 496 bp, Homo sapiens
gcccctggaaactccagtggtctgacatcatgggaatttgcccgggcggctttgtgaagggagttctgccctactcttggctgtgtcttttgttgttgtttatatagtaagtaaatatatcatccctttgaggctcagttacataatttatgtttccccagtattcagagaagaaaccagaacaaatccacttccagattccagtccagctgaatgaggttatcagtagattaaaaagttttccttgatcaccagtgacactgcttgctttcctttacaaaatcttagtgtcctgtgctgtgtggaacgtctgtctaattatcagtacgcgtggaaatgagaaaaacggatgtgaacagcagacacgtcacagcacacctgggttccttggcaacattccacttggttcttttttcaagttgtcctacttttaagcattcccagttttttgtattcacccagcgtcacttgtgattcaaaataaaccttggattct

SEQ ID NO: 19439 - DNA, 537 bp, Homo sapiens
tatattaaagaacctgaatatgaaaatgtaaaatatacattgtctttatctaggggcccataagttaggagtttttagtgtccttactgttttcttcacattttcctcactttatctcatcttctcagatacttcagggcatttgtaaagggactgaactatttcttcacaaggaaggagtatatatgaggaggagatgggcagattgccaaatatgcattaatagctttgatgtcagtctgctgactgatgacttgtttctagctgccctaggaggtcccacctggtaattttggtgacaaaagcaagtaccatgggtgtttttggctagatggttgagcaaaaaggtggtcaggcttcataggaaacaaaataggaaagggtggcattgggggcaatttctagttcttctactgtctgaatcaccaactcaaaatacaaggctgacaatgctgtctttgaattcaggagaagcaaactgaaggagaagcacaaaaatcatcacagctatggtgaaaccctgtctctacaaaaaaa

SEQ ID NO: 19440 - DNA, 373 bp, Homo sapiens
  misc_feature (328)..(328): n is a, c, g, or t
  misc_feature (358)..(358): n is a, c, g, or t
gacaggctgagggctctctaattagccacagttcccactctttttttgtcttgctcctctcttcccacgctatggcagtagtccactgccatgggcactggagtggcacctctccattcttttcttttcttccactttgatcccctgtcctcaggattctgtccctatttattaatacatttcctttttttttttttggagattgtgccattgtacttcagcctgggcaacaagagtgaaactctgtcccaaaaataaataaataaataaataaataaaagaaggggacagagacaaaggtgatgacagaaatgaaacagaaaacggnctcctcctttatacccaacctgggtcttgntggaccaggaatcct

SEQ ID NO: 19441 - DNA, 171 bp, Homo sapiens
tgaatatgagcacagacttggggatattagtgtcacctagcgttattagctagtattctccttttgtttccccataacatcccctcctccttcccacagatccactttccactcatttccatcctgtcttacgccacttggggcttgtcccttctagaatgcatccctggc

SEQ ID NO: 19442 - DNA, 456 bp, Homo sapiens
tgcctatctgtaataaggcaatgtgacctctaatataccccccgtgcttcccatcactagtctattacccttgtttattttctcagtgcatatatcaccatgtgaagttacttttacttattgttgatttcccctctagattttaagtgccagaagagcacttaccttgtttattcctgttttccaatacctagaccagtgcctgcacatagtaggcactcaatatttgttgaaaaaataaactgaaatggaaaaatatttttggcagtagctgtagctacaagttatatcactgaattttggatcccagtagagtctgcttgtgacctcttaggattctattttcgttccccctgaagattgggagctgataatcgtaaagtactgggaccccatcagcttccctctgttttcagtacacaactcatgaaaagacttacaatgtgactatcttgg

SEQ ID NO: 19443 - DNA, 283 bp, Homo sapiens
gccataacaaagataacttagactgggtaatttatacacaatggaaatatatttctcataattctggcctgtaatcccagctacttgggaagctgaggtgagaggattgcttgagcttaagagttggaggctgcagtgaactctgatcgtaacactgcactccagcctgggtgacagagggagaccccatctctaatccattattttattttatatatatttttaaattattttaaaaagaaaaaagaaatgaacctaagtgacaaaaaagcatggtttattt

SEQ ID NO: 19444 - DNA, 698 bp, Homo sapiens
gtatggtgtagtttctacatacagttcgtcatctgttagggaaaagggtagatagaaaaattcacgaaacagtatttgctatgattttcacagggtggtggaaaaccaaaggttctttcactgctctgactccatccacaagggtacaccacgagggtactttctaccaccaacttgcagaaaactagagaatgtgaccagagatcatgttttgatcccaagatgggtttccccattgggtctctttcattagcctccctgactactgacaaagttgcacagttttcaccaccatgagaaacaatctgtgtatagatgtgtaaatttccagtgtgtatttttatatggcttaagggtaaatcaggtaataaggcaagctcacttccctgaccacacctttaatcagaagtctaaggaacagactgtttaacctgtttccagtggtttcagggacttctgtattgggtgtagcaaggacaaaactggtcattacactctacccaaaaagatcattagaccatatcaggttgcagtcatgcttttggaaacttggacatgtttcttaacttctctgagcaactgtgtcctaatgtgtaaaggagatatgagactggcttgcagcattgttgtgaggattggtaattatttatgtgacaatagaatttaatagatgataacaattattaatatgctcacca

SEQ ID NO: 19445 - DNA, 403 bp, Homo sapiens
ggggttcgtgctgggggttgcccaggtcgctggctgcattctcaggtgtggaggtggggagctggctctggctagacatcacagttaaactcttcaatgactgagagattaaccaggctctgcaggagggtctggctacttctcagtgccccgcctctgctaggaacatgtcgtgtcaagtattataatctctattctaatacactcatatgataagccaatattataatttctgttccagtaaattgcacatgacacaagttttaaaaattgtggggaggctgaggctggggaatgggagactgaggcagaagggtcgcttgaactcgggaggtggaggttccagtgagtcaagattgcgccactgtactccagcctgggtgacagagtgagactctgtctc

SEQ ID NO: 19446 - DNA, 234 bp, Homo sapiens
cctgagttattcttccattgcccggtgctatcatacagatacaggactggtgactacaaacagtgttagcaggacgtacttggagctcatttggcagtgggagtggacgtgctgggggccatcccccttccacctgaagcgttcttgtcctaaagcatgttgctgagacagctgtgtagggcgtggcggtgaccctggggaaggaccgtactgagagctccagactccagccag

SEQ ID NO: 19447 - DNA, 508 bp, Homo sapiens
tggccccccaggccagccatgcaggttggacacagtcatcaagaattgttgtaaaggacagtatgaatggtgccttctagagcacagtcatgatggactgccttgggaacagtggctgttgaaggagtaactggcccaacagtggttaagcacttagcccatcgcctggcacagagtcagagcttgttaaatggtagctgctattctacagacatgccctgaggttttgatgagtggccctcaggttcacggagtgttgagacctccactgttcattgttcactgttcagatttgttgaatgtcagcttaaggatgacctgctggggccatgtccagccaagaaatgtttttccctgtgtatatcctgctcaatgtgagcctttgatccttgcacttctcagtccctctaaatcgcccttgggcactcaaagactaagtgatgtgggtgggctcacggcaacatctgttcctcgatttatccctcctcccctcaccaccccaccccgg

SEQ ID NO: 19448 - DNA, 423 bp, Homo sapiens
ggcccagaaaaaaaagtcaccttggatttccattcatgaatacatacttctgtgacataggaggtgtgaaagaagcatttgctgaatgaaataaaacttcctgaaatgtaaaaataggcaagggtttgtagccatacactaaaaattattgtaaagcactgtcactgttagcatggccaagatatacctagaagaacacttttcgtcttcttgtagcactgcttcttggatgtgataggtgctccacaaatatactattaatttaattaagcaaatttgatttagaataatctcctggccaaatgcctagggatcttgaacctgaactaattatagtcacaaagaagggcttgcatttgaaatcttcgagggttaagaatggtcaaatacatgtcacaaagacaataaaaatattccaagggc

SEQ ID NO: 19449 - DNA, 222 bp, Homo sapiens
gtccccacctccgcctcccctctaccttcaccttggtcgttccaggagagcaggagacagtgttggttgtggttcagctttccagctcatccaaactcaaattccaggcctctgactttcacaaggtatctaacaccgctaagcctcagtgttctcacctgtacgatggagtctgtactagctcttggaattaaacaagactatgtgttttggtacgtttat

SEQ ID NO: 19450 - DNA, 2386 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcag

SEQ ID NO: 19451 - DNA, 2958 bp, Homo sapiens
  misc_feature (2901)..(2901): n is a, c, g, or t
ggcacgaggctcagagaagccggggtgttgaatgtttgttttctaaaggagacaatgattcataatttgtgacactgtaaatcctgaggtttatagaaaggattcatgactttgtaatggagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctgactaaattgcaaaaccttttctactttttctttcttcatattaaacaaataaatattattaaaaatatagggccttatttaagaatgctacatagtgaccggacgtggtggctcacgcctgtaatcccaacactttgggaggccgaggcaggcaggtcacttgaggtcaggagttcgagaccagcctggccaacatggtgaaaccccgtctctactaaaaatacaaaaattaactgggcgtgctggtgtgcacctgtagtttcagctattcgggaggctgaggcagacaatggcttgaacctgggaggcagaggttgtagtgagctgagatggggccactgcactgcagcctgtgtgacanagggagactgtcttaaaaaataaacataaaataaataaataagaatgctacataggc

SEQ ID NO: 19452 - DNA, 603 bp, Homo sapiens
atgattgcatttttatatcaattaaggttatttggttcaaggcatcagaaatgtaaaggggatttgatgggaaaatgttggggtagctcattgaagtggagggggagctgcaagatctagggtagctctgagaacctttagacgttggacataagtactcactgtcatcatgattctattagcctttctcctttgtgtctctctgggattttattttcctaggctatttcgtgtagtggagcccatggcctccaagaagaggaactttctctaccacaagacaaattttggaaaggaatctgattggctcagcctggaccactttcattactagattagtcaccattattagggaaatggaaaactctaattggtgagctctggagtttaatgtgagaaagttttcccaaaggaagggattactgttgtcagaagtatggaaagtagttgttgggtacacaaacccaacggatattcaccaccatgtactacacacagctgggagatagatctatttgatgaccttaaagcaatagattgcagttggtgggctttctgaaattctccttgatacataccatgtaccctgcttttcctaaaaaa

SEQ ID NO: 19453 - DNA, 3033 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19454 - DNA, 2939 bp, Homo sapiens
  misc_feature (39)..(39): n is a, c, g, or t
  misc_feature (53)..(53): n is a, c, g, or t
atgttgattctgtttcttatctctgctctgtgtaatttnatagtggctttttntccagcctgggcaacagaacaagactttgtctctaaaaaaagaaaagaaaatttgtgataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19455 - DNA, 3507 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccggggtgttgaatgtttgttttctaaaggagacaatgattcataatttgtgacactgtaaatcctgaggtttatagaaaggattcatgactttgtaatggagttaggatccatcaaagaagcagaactactttgtgagctaaagacctatggaattgtgggaggtggcagagcggtctgcagacttgcctctgagtctcttgttcagcctgaagttgctgcagatctactagactggcagtcagacagggatactggatgtggatgagagaaaagacaaactgaaacccttgggaacaaaacggaacctgcatcagcctctcaccaaccctagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19456 - DNA, 2602 bp, Homo sapiens
gagctgtatctagaggacccccggtaacagcggtctgcagacttgcctctgagtctcttgttcagcctgaagttgctgcagatctactagactggcagtcagacagggatactggatgtggatgagagaaaagacaaactgaaacccttgggaacaaaacggaacctgcatcagcctctcaccaaccctagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19457 - DNA, 3131 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccggggtgttgaatgtttgttttctaaaggagacaatgattcataatttgtgacactgtaaatcctgaggtttatagaaaggattcatgactttgtaatggagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19458 - DNA, 2639 bp, Homo sapiens
atgattgcatttttatatcaattaaggttatttggttcaaggcatcagaaatgtaaaggggatttgatgggaaaatgttggggtagctcattgaagtggagggggagctgcaagatctagggtagctctgagaacctttagacgttggacataagtactcactgtcatcatgattctattagcctttctcctttgtgtctctctgggattttattttcctaggctatttcgtgtagtggagcccatggcctccaagaagaggaactttctctaccacaagacaaattttggaaaggaatctgattggctcagcctggaccactttcattactagattagtcaccattattagggaaatggaaaactctaattgggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19459 - DNA, 2745 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccggggtgttgaatgtttgttttctaaaggagacaatgattcataatttgtgacactgtaaatcctgaggtttatagaaaggattcatgactttgtaatggaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19460 - DNA, 2784 bp, Homo sapiens
  misc_feature (39)..(39): n is a, c, g, or t
  misc_feature (53)..(53): n is a, c, g, or t
atgttgattctgtttcttatctctgctctgtgtaatttnatagtggctttttntccagcctgggcaacagaacaagactttgtctctaaaaaaagaaaagaaaatttgtgataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggagttaggatccatcaaagaagcagaactactttgtgagctaaagacctatggaattgtgggaggtggcagagcggtctgcagacttgcctctgagtctcttgttcagcctgaagttgctgcagatctactagactggcagtcagacagggatactggatgtggatgagagaaaagacaaactgaaacccttgggaacaaaacggaacctgcatcagcctctcaccaaccctagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19461 - DNA, 2647 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccggggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19462 - DNA, 3242 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctgactaaattgcaaaaccttttctactttttctttcttcatattaaacaaataaatattattaaaaatatagggccttatttaagaatgctacatagattacaggcgtgagctaccgtgcccagtcaaaactctccgttttattttcacctctttaactcggccctttctgaggcagcaaccttcccactctgacccttaggca

SEQ ID NO: 19463 - DNA, 2539 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccggggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19464 - DNA, 2979 bp, Homo sapiens
tgtatcttgtaagcgcaatttaattagggtcaaactattctgtatggacttgctttttcgacttctgaggatttagtagtcatgattaagtgctgtcacgctactgcgatctacaaacagtagctccacaacatccgcccgcatcgtggcaaagaattatcaagaaatccccaagggggcggtgaggagccgccggtcggccaggtcgcccggtccctcagtctggtgaaaagctccgttgcccaccctgagggcttcgcggaaggaagttggccgtatcgctgcaccttagagatgcgacggccgaggctcccagctcaagcttctggtagtaaggcctgtgtgcctggcattcggggaggccacttttctatccccagcttccgggccaccacttgggtgcgtcgtggggatgtcggcagctacgtttgcggcacagctccggctaaactgaaaaacgaatcctcaggtttgacaaaactaaactaaaaagacacttttctcctctcactctgacgtcccaaaagtttcctttttaggggtcggggcctacggtgggcgaggagaaactcgaggtatctacccaccgcaccaaacaactcatgcgtcgcttcctttcgacttggagctggccagtatcccggcgtcctctcggccgacgctgcggtctgaggccactctggccggcagccgacgtctctatggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19465 - DNA, 1059 bp, Homo sapiens
  misc_feature (39)..(39): n is a, c, g, or t
  misc_feature (53)..(53): n is a, c, g, or t
atgttgattctgtttcttatctctgctctgtgtaatttnatagtggctttttntccagcctgggcaacagaacaagactttgtctctaaaaaaagaaaagaaaatttgtgataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggaggtatgttttgcattttttgtattttggtcacatctcttgggtgagagtacctggaaatcattatttccagatcctggaagaatctatagaaaataatccatcttaatgctttagagaacaattttcattattgcaaatgatcaagaatgagcattgttgtagactccattatcatttaaaaaatagttgttatctgcaaagtaagtacgcttcacataaggaatctgcataagttatttcttgtgtctattattacataactatgaacaaatttatgttatacaataaatttgatttatgagattggatgtaattttattaataccaattagtgttatatatttaatgtgcatattaatatatatttataatgttataccttttttttacctttttaaaattacacttttaagagactgactttaacaatcaagtatgagttgtttaattactcctggctttaacttttcaaagtagctttattggttttatggtcataacagtaagacatcgaaatttttcaaaaattca

SEQ ID NO: 19466 - DNA, 681 bp, Homo sapiens
  misc_feature (1)..(1): n is a, c, g, or t
ntagagtttccccgactagtccaaccacactcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaaca

SEQ ID NO: 19467 - DNA, 984 bp, Homo sapiens
  misc_feature (39)..(39): n is a, c, g, or t
  misc_feature (53)..(53): n is a, c, g, or t
atgttgattctgtttcttatctctgctctgtgtaatttnatagtggctttttntccagcctgggcaacagaacaagactttgtctctaaaaaaagaaaagaaaatttgtgataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaaggtgagctaacagatcggcagcacatgcaaacttcacagtgtgctctccattgaccttcacggtgtaaaaaatatgacttgcttcatttgtgagttccatataatgtctcctatagccaacagtacccagaactatataaggaagggaattctgggaaatgtttttaagtccgagttagctgagttgatacagtacaaagccattagagctctagttaactgatctttttcatcttttaatagagttttgttgtttcattcttgctattttaattcttggcactttgagttgctattggaacttctcatttt

SEQ ID NO: 19468 - DNA, 1071 bp, Homo sapiens
  misc_feature (39)..(39): n is a, c, g, or t
  misc_feature (53)..(53): n is a, c, g, or t
atgttgattctgtttcttatctctgctctgtgtaatttnatagtggctttttntccagcctgggcaacagaacaagactttgtctctaaaaaaagaaaagaaaatttgtgataatatataaacaaagattgagtggcagcagagcttttgtgttaggcgtctgtgtagtctgtgcccagcctaggttcttctcatacctgaatggccttctttctcattagggctaacttacaggccatactttattgaaggaggggaatattgctgctgccgctgctctgggttggccattaattcaagttttcagtgtccctgtttcagtccagctaagtggataagggcatttatttttagttgaaagggacattttatcaactttaaagttatatgcattaaatatttaaatatgttgacttctttatccattcaggtgttgaatgtttgttttctaaaggagacaatgattcataatttgtgacactgtaaatcctgaggtttatagaaaggattcatgactttgtaatggagattaatttggagagaataacaccatcagtgttgtcttcttatgcaaaaaaaaaaaaaaaaaaaaaaaaaaaaaaaaacttggtgcgggcgcggcctccggcgccctccggaagaacgttttcttaaaccattcgcggtggggcgcgcgcgggggcccaaggagggataaggggacacggggccaataggcgggttccctagaggagagaaccgggggccaaggaacaagaggggcgagggaattctctctccaccaaatataaaaaaggcccgcgggggccacacgagagagggtttgcggagaacaaatctccagagaggggagttctcgagagagggctcattaaggggagactcttttcacagaggggagtctcaagggggaagctcggaatattctccaattaaggccgccggtctgggtgggtggacaaaaagaataacacaagaaacgaaaacgaaacacaaaaacagaaacaacaaagaaaacaacaaatagaacagacacaaaagaagaaaaaagaacacaaaactaacacaaga

SEQ ID NO: 19469 - DNA, 2454 bp, Homo sapiens
  misc_feature (413)..(413): n is a, c, g, or t
  misc_feature (577)..(577): n is a, c, g, or t
  misc_feature (1287)..(1287): n is a, c, g, or t
ggaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcnggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcngcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtgaggacacagagccaaaccacatcagcaacatgtcagaacacagaaaaaatgtaaaatatcactgtatttctatgtactagtagtgaactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggtagggtagaaggggcagtacaccaataggcctgggtatnctagaacaataggcctagaacttctcatcagctcctgtttcttttcatctctaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataacttt

SEQ ID NO: 19470 - DNA, 808 bp, Homo sapiens
gggaatggagggaaataaatgactggatggtcgctgctttttaagtttcaaatagacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaagatgtgtaccatgtgatggccaagggagcttcatcaatcatggcatctcaagggagctggagcagatgaggaggagatggaggtcccaggaagggctgtgatctgcctggggtcccacaatgggaaacagaacaatccatttcacagatgcaagaaacagactcagtgagcacgtgatcacttctcacaactaatggagccaagattctgtcccttatggctccagagacctcttctattcccactgtagcacaacaatcaccaggactggagtgccacctatgacctcatgcctaatggatg

SEQ ID NO: 19471 - DNA, 2423 bp, Homo sapiens
  misc_feature (413)..(413): n is a, c, g, or t
  misc_feature (577)..(577): n is a, c, g, or t
  misc_feature (1287)..(1287): n is a, c, g, or t
ggaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcnggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcngcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtgaggacacagagccaaaccacatcagcaacatgtcagaacacagaaaaaatgtaaaatatcactgtatttctatgtactagtagtgaactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggtagggtagaaggggcagtacaccaataggcctgggtatnctagaacaataggcctagaacttctcatcagctcctgtttcttttcatctctaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaag

SEQ ID NO: 19472 - DNA, 1588 bp, Homo sapiens
gggaatggagggaaataaatgactggatggtcgctgctttttaagtttcaaatagacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaag

SEQ ID NO: 19473 - DNA, 361 bp, Homo sapiens
ttaagtgcatgtggtgattcatgtgcatggaaagtaccttgggctgaccacaaactagagttccctacaactacatcaatgtcaaaactaaccactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgc

SEQ ID NO: 19474 - DNA, 316 bp, Homo sapiens
aagttatcacattaccatgtctccaaaaggcttctagtaaatatgcatgtttctttcttagcaaagaagtgatgataacacaatgggagtcatgaacacctaagcttatgtgcaagatcccaaagggaaggagctataagggagttgtggaaggagaaaaagcttaatctaaaatcttatttagaaatgattcttctcaaacccctgcttactactactggaaaataacaccaccaagactgagaacatttcagtagaggagacaccacggaagccgtacactgattttcaacactaatcattagatcacagataa

SEQ ID NO: 19475 - DNA, 330 bp, Homo sapiens
tcttattctctcttaaactttacctaatcagggttttttgtttgtttttacctttgctgtaccatgaaaactttcctttcaaaaccaacagtgacctccatgttgccaaattcaactgtcatttttttctcagaccttatctaacttgatctgccatcagcatttggcacagttgctcattccttattcttggaaacacacatgcctttttttcttcctacatttctgagtattccttttagccttctttgttgttatgcctcatcttttctacttctaaatgatggagtgtcccaagagtctgtcattgttgcttttctaacctatagc

SEQ ID NO: 19476 - DNA, 1017 bp, Homo sapiens
aataattccatctttcaaccctcactcctgttttcttctggttcctcaattatgttttcttcagcgtcagttaaaaaactttcttgtcatgcttcacattttccttagatggtaggtgatttttggatgcctttttatattaatgatgagacatttgggaggtttattcattaatacgcttctcctttatgtgagtagatagggagctggctcttacacttgagggtttttcattttttaaaatacagataaagcagactttaaaggataaaggtggtggttatcagtgttgattaatcaagttgggctcaaggatttcacaggtcttaaatgccatcacacagactgccatgccaagggcattctgaatgccaattacagattgaagttccttcagaaaccaagatgttatcaaaaactgatgaagtctgggtttctcttcaagtaagacaaacacatttcttacatagagaaaatagattacttggttctgaaagttaaaacactacgctgaataattccccttccccttccccacaagtccctaaggcaatattacggttgcctctgacagttaaaatttcagcatttcaatagagcgggctgaggagaactgggaaaaatgaaaagcaaaattaatgtaattgatatggggggtattttttaaaaaaaatagagacggggtctcacattgttgaccaggctgaatttgaactccttggctttagtagctggaatttcaggcatgtactaccatgcctggcaaggcagtatagaaacataaagactcacagtaggattgacttacgagacctttcagcactgaaggatatgagtttccaagtatgtatagtctatggaatgacagtgtagtggatcaaaaatagacactgcaaaatttcacaacactggggatggaaggaagatattagaagcatccagactggggaaaaaaaaaggtcatatacaaaacattaagaatctgaatggcttttgtccttggcacaaattagaagt

SEQ ID NO: 19477 - DNA, 725 bp, Homo sapiens
ccactgcactccagcctgggcaacagagcaagactcagtctcaaaaaaaaataataaaaataaataaataaaagagtcagggtctcttattgctctgtccccaggctggagtgcagtggggtgatcacgataatggctcactgcagctttaacctcctgggctcaagccatcctccattctcagcctcccaagtggctagaactacaggcatgtaccatcacacccgactattttttttttttaattttattgtaggcctggtgcgatggctcacatctgtaatcccagcactttgggaggctgtgagcagaacacttgaggtcaggagttcgagaccagcctggccaacatggtgaaaccacatctctactaaaagtacaaaacttagtgggattacaggcgtgagccactgcgcctggcaaggaggtgatctttctctgttgcccaggctggtctggaactcctggcttcaaggagcttttggcctcccaaagctctggcatgacaggtatgggccaccgtgcccggcctgtgaccttccttaaccctcacaccacactgtaacacagggatcacgttatgctacaattatgcccattgaacagatgagaaaatggaggctgaaagcgactacacttctattttcctctcagccacagtcactaacactgtgtgcaaaaaatttctgactctccccctttggaccaaacaggtggatggcact

SEQ ID NO: 19478 - DNA, 466 bp, Homo sapiens
agtatttgtcctttgtccaaggttcctgaagcggccttgggacagcttcagagcagtaaaggtgaaagacagtcttttgttagaatgttggggcactctaagcctcagaagcaggcctcagaaaacagaagctctgtctgtctcttgccctctaatcatcccctgcctttctgtcttagagctggttgtaaagaaattctctgacctatctcgtctgattgtttcagagggggtcctgccccttacccagtaggaaggaataccacacacagaggccagggagaatctggatgggccttgctgggtgtctgcactcagtcttagtattagatcacactctctgtccagtcaattactgtgaggttggccatgcttcaatcatctctctaatgaaatctctacaaaacgcccaagagaacttctggatagtctaacaggtggaagtttctggagggtggtatgcctg

SEQ ID NO: 19479 - DNA, 418 bp, Homo sapiens
gcagacattcttccagatcttttcctaagcattgacataggacatgtgtacagatacatagacattgtttacgtaagcagaatcactatgagttgttcagcttgttttttttttcacataaaaacgtatcttgggggctgggtgcggtgtctcacgcctgtaatcccagcactttgggaggccgaggcgggcggatcacaaggtcaggagatcgagaccatcctggctaacacggtgaaaccccgtctctactaaaaatacaaaaaattagccgggagtagtggcggacgcctatagtcacagctactcgggaggctgaggcagggaaatggcatgaacccaggaggcagaggttgcagtgagctgagatcccaccactgcactccagcctgggcgacagagcaagactccgcctcaa

SEQ ID NO: 19480 - DNA, 396 bp, Homo sapiens
gttcttccatagtgggttataaattttagcagtcagtacaaactttttcctttaagttttgttttcttgatggactgtattcaaaataaatacctgaacaaataccaactatataacatgaagccataaaacttggtctttatatataaataaagtttatcttggggtcagatgtctgtgctgttttctatatttttttatatccaatagtttggtctttttcctttcagttttgtatgcttttcttgtaatcgagccttggaagagacagagccactgagcccaaaacctagctttgtggtcggctgtggtggctcatgcctgtaatcccagcactttgggaggctaaggcgggaggattgcttaaactcaggagtatgagaccttgtctctatt

SEQ ID NO: 19481 - DNA, 373 bp, Homo sapiens
caaaagcagaaaggagagggagtttataatccaatatgatatgataaattgtcagaagattctcaggatagtggaagtttgagcattttggtagcagaggggaaggagacgttagacaggcaaggctggaagaactagagggtaactggtggaatgtggcccatgaagagactgggaatgacatcaaaggtgtatttgcctctttttctttcctaactcctttcacccactttcctacatatctgcaacatatttctctctccttgccttaaatgtcagtgttatttggtaacattttgcctcctgttcttaatttcaaaagtgcagaaaccaaaccttgtatatttcagctcccaaaaacccatattgttaa

SEQ ID NO: 19482 - DNA, 235 bp, Homo sapiens
tgtcattttcatggaatctggagttacggaaccatccaatgtttattacagagaatgaccacccataagcctctccatgcttatggaagcaacagttctggggccgctggctgcatattccttccaggtgtttatttctgggtctacatcatgtccctcactcatcaatttaactctatccagagaattcctctatggtcttcatcagattaggaagtaaatcatcagtcacttc

SEQ ID NO: 19483 - DNA, 455 bp, Homo sapiens
caatgattaccgctcccggaggcctactgagaccagccagcacatgtttgcttttttgcaatcacgcagcggcaccaaacttcttaccctgttgtttcaggcgttcccacagcctggccctagccttgccttcttcattttccactcttcccttgcaggtgcggttggctatagacatcttgcattctccaagccttttatctgtctttagtcagatagttccatctacctaaaaggccctttgcccttctctctcccatatccacctgctctcaacctgcctgtccctgaagaatgacatggcccagatgccaaagcctccatgaaaccccctggctgcctcagccgccctagactgtatctgtacctctcttgtagctcttctgtctcagttgataggaattgtgcaatgccctgtctccctagagaactccctgaaacgcttgagaggcaga

SEQ ID NO: 19484 - DNA, 598 bp, Homo sapiens
acccccaaaggcattgtttcctcatctcaacaagaatccagcacccgtcattttatcagcacacgtcactagcttctcaagtgagactactctgaagtgatctgtgtttgaagaatgcctttcccctttccccttacgtaactaagaggatgaaaaaggacactcactccctatatgaaagctgtgtattgtaagcagtcatcttgcctggctgagaactctaggatctttttctctgctctcctttaggctgacactcatagccagaccttctgtttattagccccctgaatctatttgaaaatatttttgctttcattataatataagtcacattcttcttgcatctgccgctgcattttccaaaagggttatgtcaagggaaattcaacactcacttttctcattatttgcttaccagcttgctcactcatcaaaataccagagttatttgatacttcagaagattatttccccctttagatgatgtgtcaagggaaggggagctggccccagtatcaggtgacagaattttcttcgcatttctactgttgactcaataaatgcccttgggcaagtcatggagcctcttcatact

SEQ ID NO: 19485 - DNA, 385 bp, Homo sapiens
gatagatcgtgtcctagagctaaatcatgagtactctggttttatactaatatactagattattggtattaaacatactctaaaatgtccaactgtaatattttctacaggaatagaaattgtgaattaagaaaaagtgttggccagacacagtggcttacgcctgtaatcccggcactttgggaggctgaggcaggaggatcgcttgagcccaggagtttgagaccagcctggtcaacacagtgagaccctgtctctacaagaaatacaaaagttagccaggcatagtggtgcgtgcctgtagcctgagctactgggaaggctgatgtaggagaatcacctgagccctggaggtcaaggctacagtgagccttgatagtgctac

SEQ ID NO: 19486 - DNA, 236 bp, Homo sapiens
aacactgcactccagcctaggggacagagtcagattccatctctaaaaagtaaaaacgcctggagccatggtgatactgtataccaaggatctgcaaactatggaccatgggctaaaatctggcccacagcctgtttttatatgtctggcagtctagaatggctttcatattttaattggctaaaaaaatgtgaaaagaataataatattttgtgatgtgaaaatgacatgaaatt

SEQ ID NO: 19487 - DNA, 210 bp, Homo sapiens
cttgattaatagaatgccaatcatgttgtttttatatctctctttctatgtctactgtgatgtgagaaacactcagaggaatgggtgagccaggtgccttcccctgctccctactttgccaagttgataactcctttgacccttgaacattaaccatgagcaccgatgcccgtctttcattcaggctgtattaaagtccactttgcaaag

SEQ ID NO: 19488 - DNA, 526 bp, Homo sapiens
aaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaa

SEQ ID NO: 19489 - DNA, 427 bp, Homo sapiens
ggcacatgtatacctacgtaacaaacctgcaggttctgcacatgtaccccagaacttaaagtaaaataaaaaaaatgctgttagtcctctaatatatattgcatccaaaggtgagcagcaaaagcattataagatacaaataaaattaagaaaataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagt

SEQ ID NO: 19490 - DNA, 344 bp, Homo sapiens
gtcaatatatacataatacataaaacttttatgatcatttaaatctccctaaaaatgaatatgaacaaatctatcacgtaatgaacactttcttccattttcttttctcacaaaagctctcttaaatttggtgtttgttttatgctaaataattaaataattctttttagtggcgtaacacactgaatatactttaattttattttatgtttctgtctctctgttttatcttagtataagaaaatccttgaaattagataatttctaaaggaaaggggtctatttagctcacaattgttgaggctaaaggggccaagattgttcagcttcatctggtcgacttc

SEQ ID NO: 19491 - DNA, 279 bp, Homo sapiens
ccttactcggcaagtgttcttggcagagcatcctattgaaaatattgcagtcctaaagaatgtctagtgatagaccttgtcatacaaacataagtatatgtgcaaaatttgcaagccatgcaaaggataagatgcttgaaggaggttaagaaatttcttgtggagttttagagagtccttggaaacagttcttttcttagacatgtaatcatgagttccctctccttcatgtcttcccagccctattttgtctggatctgacaaaaacaatcatccagt

SEQ ID NO: 19492 - DNA, 243 bp, Homo sapiens
cttgagtccaggggttcgaggctgcagtgagctatgattatgccactccagcctgagcaacagagcaagaccttgtctaaaaataaaattaaattaaaaaatccagttagagaggataagcgtattttacgaatagagcaaagcaaagtctagaattggcttccctgcgcaagaataccatattactgtttggaaaagagaagttgctacctctagaccaacagtcaagggcccttcagccct

SEQ ID NO: 19493 - DNA, 527 bp, Homo sapiens
acagataagaatatcgaagcacatataagttaagtaatatgcatagggtcacaaattattagtgtataactctgaattgaatttagatctctttgattccaaggcttgggatcttacatgcccctttattaggtaggaatagatacttcatgaagatgataacatgccatctacagaatacgatatggcattgatgtgacactttacctacaaaatatcttatttctgagtcttccgcaagagaaaaagcaattttatttttatgggacaagattggatgttacatttttaatcaattacatgtaagtgtattctacctttaaaattgctatggaaaagtttaattatttccaacaggatttataactatcagttatacctcaaagttgttattaactgaataaaactacacattccaaaatgattaactcttaaagcgcattattggtacattcataatgtttaattttatttttatcatccttgctcatattgaataaatgccttttaaaaccaaaataagattg

SEQ ID NO: 19494 - DNA, 367 bp, Homo sapiens
ctgtgtttctgtttgcagcctctcctttaaggtgctgttggttctgggtgggttcaaggtcaaggtggtagggaggggtttctagttagagtggcctgaaggagggtcccagaccaggaaccagaaagtataacacaacacccacatatacctcactgctcctgtcctgcccctggcatggacagcacaggggatgatttggagaccagagggaaactcatccagattcatgcaggctgctacagaggctacacctgggcattgttctggtgatggtgcagagcctgacagattaatgggattcaggaaagaaggtgaatattggcctaacaaagaaacactgccttatttctgaggatgcatgcca

SEQ ID NO: 19495 - DNA, 266 bp, Homo sapiens
agggagtagcaggagatgaagctggaaagatttcctaacactaggtggtaaaaggaacttctctaacctggtaagaagtttggattttattctgtaggcaaaaaaataactcaagctgagtagaatattataaaatttttgtttaaaaaagaaaacttggccaggtgcggtggctcacacctgtaatcccagcactttgggaggctgaggcaggtggatcacccaaggtcaggagttcaaaacaagactggccaacatggttaaat

SEQ ID NO: 19496 - DNA, 362 bp, Homo sapiens
  misc_feature (13)..(13): n is a, c, g, or t
  misc_feature (137)..(137): n is a, c, g, or t
tgagtgggcggcnaaaaaaaaaaaaaaaccagaatcagctcagctggcctccttttcacttgctcgtagcatggccttacaaagttgcaaagacctgctggaatcaaggcctcatatttcagaataataatgggaantcaggctgggcacggtggctcacacctgtactctcagcctcttaaagtgctggcattacaggtgtgagccaccacgcctggccagggaagggtgagttctattgtcaccactgtttctgctgctgctaccttctcaatctagaaggtggtccattccattcctccttttccagatgagagatctgaggccagagttcccaaactatactctaaagattcttaaaa

SEQ ID NO: 19497 - DNA, 368 bp, Homo sapiens
gatcccagggttgtcaccatctgatcaattgctttttctctgagcctggcacatagtaagcactcaataaacgccactgcctgggccagggtcagggagggatccaccttcctgtggcctggctgccctcctggccaaaaaacctccctggtacagtcccttccatagcttgggctacagctgactgctctgggctggcaacttcctgcccggagcagcctgagcagccgcctctcccctgagaagatcttttgttccagctccccatgacgccccgagcccagcccatgaggcaggcccccctgtggcttcccatggcgggcgagcctgactccgaggctggagctcttttctaacagtgatagtaa

SEQ ID NO: 19498 - DNA, 523 bp, Homo sapiens
gtaaaagatctccagccagtgcttctcaaataactttattacataccagagccaccaggggagcctgtggaactacagattctgagttagaaagtctggggtggagcccaagactcttgctttctggacaagctccaggtgatttctgatgctgcaagtctggctttagataacagctgctaagtttgcctgaggatgaaagcttgagtaaactctgaatactgatgttacaggactccagcactttctaactatatacatttgaacataagagacagattttatagctaaaaaggtttggctttttgtatatatttcttattgatacaaatatgtgtacatgtatatgggggcacaaatatgatactctatcacatgcttacactgtgtaatgatcaaattaggggtttggggcatctatcacctcgagtattcgtcatttctgtgtgttggcattattccaagtcctcttttctagctattttgaaatctacaatacattgttgttaactatggtcatcct

SEQ ID NO: 19499 - DNA, 502 bp, Homo sapiens
atatgtacatctactttttcaactgtaaatttatgaaatctaaatcaatgaaatatttttgatgaaaatttagtgtccaaattaagatgtgctgttgtttcaaattcaagctaggttttgaagacttagtatgaaaacaaagaatataaaatacttcactgatatgttcatattgatgttttggatgcatggggttaagtaaaatatattattaggctgggtgcagtggctcacgcctgtaatcccagctctttgggagccaaggcgggctgatcctttgagcccaggagtttcagaccagcctggtatcatggtgaaatccgtctctaaaacaaatagaaaaattagccaggcatggtagtgtgcacccatagtcccagctactcgggaggctgcagtgggagaatcacttgagcctgggaggtcaagggctacggtaagccttgtgatcacgccactatattccagcctgcgagacaaagtgagaccctgttgcacacaa

SEQ ID NO: 19500 - DNA, 520 bp, Homo sapiens
taaaacttgcattggctcctccttcaccttccgccatgattgtgaggccaccccagccatgtggaactctcctactgcactgagaagcacgtgttctccatttccctgggggagaccattgtattgggcagtttggaacaaaacaccatggactgggaggcttacacaacagaaatttatttcttgctgttctagaggctgggaagctcaaggtgctggctgcatattcattctgaggcctcttctgatgtgcaggcagctgccttctgacttgtgctcacattggagagagggagtcagctttggtgtctcttcttgtaaggacactaaccccattcactagggccccaccctcatgacctaatcacccccaaaggtcctgtctccagacatatcacatggggcagagcttcaatgtaccaattctggggggtcacaaaccctccgtccatagcagacatcttggttgctcccagtttttagagattaagaataaaacaactgtaaatatttacatgca

SEQ ID NO: 19501 - DNA, 401 bp, Homo sapiens
cctgcctcagcctcccaagtagctgggattacaggtgaccatcaccacacccagctaatttttgtagtttgtagtagagatggggtttcaccatgttggccaggctgggcttgaactcctgacctcaagtaatcctcccacctcagcctcccaaagtgctgggaatacaggtgtgaaccaccacatctggcctatatttactatttatttctaatatttacattggaaatctgaatacatccaactcttaaggttctttcttgctttccttcaattaatatttgtatctcccattttcataatgaaaatcctgtttcccaacaatatcaatatgtttactcattttctcaattctatgatacatctaaaattatttcagaattgcttcactactacaaaaa

SEQ ID NO: 19502 - DNA, 771 bp, Homo sapiens
agtctggtgggttttttttcttcttcttcttttttttttttcctacacttatcacagagcctgacactgagaggcattcacattttatttttttcaggtcattttgctcatcaataagtttcctcagatatcagggagtagtgaaaaaagaatgcgttttgcagaaagatgcgcctgagtttgaattccccacctattagttttgtgacctcaggtaaatcacttaacctctctgggcctcatttttctcatctgtgaatcgggagagcagctaaatacacataagggctttactaccatattagagctggttaagtgtttaattaatgatagttcctggctctaccttcttcctccagggactgctcaagcaatcttcccacctcagcccctcgagtagagaggaccacaggtacacaccaccacacctggctaattttattttttgtcgagatgaggtctcactatgttgtccaggctggtctcaaactcctgggctaaagtgatccaccctccttggcctcccaaagtgctaagatgacaggcgtgagccacggcgccctgcctagttccaccgtcttatctgaaggctcggggtgacagctggggccagtcactgactccgacttccgccccaacaatgcggatttgagtttccacacaagatgtgactctagagtatctttattaacatgtcagaaggtttcctgatgtttctgcttacaaagtcttcagctaacttccctcttcccctggccccagctgtagttt

SEQ ID NO: 19503 - DNA, 398 bp, Homo sapiens
agtataataagatattttgagagacagaaaccacattctcatgccttttatcacagtatattgttataattattctattttaattattatttatctcttactatgcctaatttagaaattaaacattatcatagaaatgtacatataggaaaaaatatatgtagggttcggtactatccttggtttcagacatctactgagggtcttggaatgtgtcccccacagataagaagagattgctgtaataactgttttaacgttcatgtttgttaattatgtcatctgtgcaacttcctggcctgtttctattgattgatttttttttcttaccatagtttatatttttctgctttacatgctgataactttttattgaatgccagttattgtaaatttta

SEQ ID NO: 19504 - DNA, 443 bp, Homo sapiens
caatagcaaagacatggagtcaatccaagtgcatccaaggtagattgaaaatccaaggtagattggaaaattccatatataccatggaatattaagcagccataaaaagaacaaaatcacatcatttgcagcaacatggatacagctggaatccactctcctaagcaaaccaatgcagaaacagaaaccaagtatctcatgttttcactcatgtggaagctacacattgggtgcacattgtcataaacatgggaataatagacactaggaaataaaagcagggagggacagagtgggccagggttgaaaaattacttactgggtcctacgcttactacctgtgtgatgggctcaactgtactgcaaacctcggcatccctcaatatgcctttggaagaatcctacagaggtaccacctaaatttagaatacaaactaaaaaaa

SEQ ID NO: 19505 - DNA, 596 bp, Homo sapiens
agcgggcggaagggcagcgtcgcggtgctggaggctgttgctgggaggcgtggattctggaaagccgcatcgggaagctgggtatagagaaggattaacagagattgcaccctggtgacctttcccctcaggcacgtgactcttgccccttccaagttgtcatcctcattgtgaaattcacctggtagctgatactcaggagaggaatactttggaagcctgagtcttctagccatcacccttctgtttttctctcaaagctccacttggagctcagctggagaaggaaccctgtgaagtctggaattggacatgtctcttattaacgaagtaattgtggagaaaacagcattcttaccactatcatccaggaaagtatcccaagtcccttccttggcagtagcaaacttcccttaattcccttccccttgaggagatgcagccagaatgagagccttaagcagagtttttgggtgaaatgataggcatgttctaggaattgtgacttaaacttggacctcttgtgattttttttcttttcatcttaattactgcatttcactcattcatcatgaaataaactcttactgaaggct

SEQ ID NO: 19506 - DNA, 229 bp, Homo sapiens
accacacattacatctctggccccagtcaaatcatttgtaaatgcacatattttggcaaaaagtatcctaagtctacctttattggtttaaaaccaagttgtgtcagaatatccttcaacactaagaatgtatttttttatttttattttttttgagacggagtctcgctctgtcacccaggctggagtgcagtggcatgatctcagctcactgctagctccacttcct

SEQ ID NO: 19507 - DNA, 481 bp, Homo sapiens
gggaggggacgctgggagagaggcacgtgcccctggactcagaggagccggaaagaggctgactttcatttcagcttccatttaccagaggaagggagcccacaggggcagctgctggcctgtcccccagccagcaagtcacacaaaccagctccagctggtgtcactggggcctgaggtagaccatgctgctgggaagaggctactggggccaacctgaccccgtggcccccacctgaccccttcccaggaagggccccccacccagcacgggggcctgtgggcgcctggccgtcctctcctctccttacatgcccttggccgaaccactgtactcttccctctcaaggtcacagggccgtccacaccaggaatatttactcactggactggccctgttagcagcactcaccacaaatatgctttctgataaagttggcagaaaaaaaattctagagctcaaaccaatgtcagaaatcat

SEQ ID NO: 19508 - DNA, 478 bp, Homo sapiens
ggattctcccaaagcaccttgaactcctagagactaagacttacaaaaacaaaatagacttatgggacaatattttcttcaacatgccgtaaatataagataattgattgctgtggataaattattacaaacggggtataccagtacttcttcaagctagtgttcgtagctaaatggttaagtatacgtaggtaagtgtgttgtttgcttagtatcagccctgccctttcatctgtcgtccttctctccgtgactgggtttctcacccttctggttacctaggctagaccctcagcactgctggccatcctccctgccctacctacgccaccacaatcaatcacccaattacttaaactggtttcattccaaaattttgtgtaaatttaatgatggaaaagaactctgctttctcttatgctttccttcagtgtgcttaatgataaaataaataattttacagacttaaaaaacaaaa

SEQ ID NO: 19509 - DNA, 827 bp, Homo sapiens
atgctgtcatcaccagtaagataccccagcccggttggctaacccctagctcagccctgtttgtggttaggggagttctagacagaacataattagacccctgctacttcctgaaacctcagctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccaggaaacgccaccccagtgaccaccactgcgccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaaccttcacagttaaca

SEQ ID NO: 19510 - DNA, 3790 bp, Homo sapiens
  misc_feature (2375)..(2375): n is a, c, g, or t
  misc_feature (2441)..(2441): n is a, c, g, or t
  misc_feature (2484)..(2484): n is a, c, g, or t
  misc_feature (2497)..(2497): n is a, c, g, or t
  misc_feature (2612)..(2612): n is a, c, g, or t
  misc_feature (2637)..(2637): n is a, c, g, or t
  misc_feature (2646)..(2646): n is a, c, g, or t
  misc_feature (2667)..(2667): n is a, c, g, or t
atgctgtcatcaccagtaagataccccagcccggttggctaacccctagctcagccctgtttgtggttaggggagttctagacagaacataattagacccctgctacttcctgaaacctcagctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggataaacccaacaagcgcagcgaggctgtggggaaaccggagccctgcacaccgccgggggaaggtgggccaccgccaccaccgtggaagaacagcgcggaggcaccccacgagatgagacggaactgccgtgagatccagcaatgccaactgtgggtctgacccaggataacggaaagcagggacgtgaacagccctcctcatgttcttgacaccgtcattctcagcagctcagctaaggcacagaggcagccgagcgtctgtcagcagagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggangagcgacacctccaggcttccgggagcccagagagcatgtggcaggcagtggggcctcttcatcancagcctgcctggctggctcccttggctgtgggcaggtagcacncctgctggcagangtacctggtggctgccctgttcgcatcagtggcgatgactttatttgcggagcatttctgcaagcgttgcctggatgcggtggtgcattgtgggccctctgggctcctgcctcanaatgtcagtgagcaccatgctggangtcacccancactgtggcagcgcccagganggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaaccttcacagttaaca

SEQ ID NO: 19511 - DNA, 4023 bp, Homo sapiens
  misc_feature (2608)..(2608): n is a, c, g, or t
  misc_feature (2674)..(2674): n is a, c, g, or t
  misc_feature (2717)..(2717): n is a, c, g, or t
  misc_feature (2730)..(2730): n is a, c, g, or t
  misc_feature (2845)..(2845): n is a, c, g, or t
  misc_feature (2870)..(2870): n is a, c, g, or t
  misc_feature (2879)..(2879): n is a, c, g, or t
  misc_feature (2900)..(2900): n is a, c, g, or t
atgctgtcatcaccagtaagataccccagcccggttggctaacccctagctcagccctgtttgtggttaggggagttctagacagaacataattagacccctgctacttcctgaaacctcagctaggactgcagggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggataaacccaacaagcgcagcgaggctgtggggaaaccggagccctgcacaccgccgggggaaggtgggccaccgccaccaccgtggaagaacagcgcggaggcaccccacgagatgagacggaactgccgtgagatccagcaatgccaactgtgggtctgacccaggataacggaaagcagggacgtgaacagccctcctcatgttcttgacaccgtcattctcagcagctcagctaaggcacagaggcagccgagcgtctgtcagcagagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggtgctgaggccaggtctgtctgcggcttcctgctgacctggaggtgggactccatgatctgtaaccacagaaggcccagaagcatgaactcagccagagtgggcagccaggacactggagctggtggcgctggcagagcttggggaagtcacaccactgcacaccctgcgtgacctctagcaaccccctggctggaaaggatgagtttctgacctcggagagctgtgtttgaggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggangagcgacacctccaggcttccgggagcccagagagcatgtggcaggcagtggggcctcttcatcancagcctgcctggctggctcccttggctgtgggcaggtagcacncctgctggcagangtacctggtggctgccctgttcgcatcagtggcgatgactttatttgcggagcatttctgcaagcgttgcctggatgcggtggtgcattgtgggccctctgggctcctgcctcanaatgtcagtgagcaccatgctggangtcacccancactgtggcagcgcccagganggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaaccttcacagttaaca

SEQ ID NO: 19512 - DNA, 2760 bp, Homo sapiens
  misc_feature (1345)..(1345): n is a, c, g, or t
  misc_feature (1411)..(1411): n is a, c, g, or t
  misc_feature (1454)..(1454): n is a, c, g, or t
  misc_feature (1467)..(1467): n is a, c, g, or t
  misc_feature (1582)..(1582): n is a, c, g, or t
  misc_feature (1607)..(1607): n is a, c, g, or t
  misc_feature (1616)..(1616): n is a, c, g, or t
  misc_feature (1637)..(1637): n is a, c, g, or t
agcaggctggtcggtcggaatttaggatcaaatatccgaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggangagcgacacctccaggcttccgggagcccagagagcatgtggcaggcagtggggcctcttcatcancagcctgcctggctggctcccttggctgtgggcaggtagcacncctgctggcagangtacctggtggctgccctgttcgcatcagtggcgatgactttatttgcggagcatttctgcaagcgttgcctggatgcggtggtgcattgtgggccctctgggctcctgcctcanaatgtcagtgagcaccatgctggangtcacccancactgtggcagcgcccagganggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaatttaaccttcacagttaaca

SEQ ID NO: 19513 - DNA, 212 bp, Homo sapiens
ttggggaagtcacaccactgcacaccctgcgtgacctctagcaaccccctggctggaaaggatgagtttctgacctcggagagctgtgtttgaggcaggttgctgagatcactttgatctccttttcttttgccctctcccacatttaaggacttttgtgattccattgggcccaccagatagtccagaataatctctttattttactgtca

SEQ ID NO: 19514 - DNA, 456 bp, Homo sapiens
agtcgcagtggctaatgtgacgttttgatgcctgttggcttggagccttgcttgtgtttctcatgtgggatgcaacggcagattctcaacatttaaaaaacacctacgaatcaacgggccacttagtaaattagtaaatactcactagccgtttgtcaatgggttaacttgtgactcaatctgatttccctaaaacaatttcaacctactctttttccaggtcattttaaactctcagagtgaacgtcttgataggaccgacaagacgcatgacatgtacttagaaagcttatcttagagccacactgagattggaacccgcaaaatatgccaggtgagagagccttctccgactttgaacatgtaagaggaagcccatgagaatttttccatgaagcatgttgtctcataattcaaaaattaacgcataaaaatagattatcgagataaaaacta

SEQ ID NO: 19515 - DNA, 390 bp, Homo sapiens
ctctagaaaaaactattattttaatatgcttttttcctaaagagaatataagtatagttcagtctttcttcttctataattgattgaattttattattattattgatagttgggattcatgagcttctcacacagagacacttcgtgcttgtagtactactataggttttggcccacaaacccataaattgtaataagttctactgtttgagatttcctataaaaaataaaaataatgctttgtgcatttaaaattacatattacttgtctatattttacacagaatttatacttttagttgacattgttaaaagcctaatcctttgctttaatgtctgtacatttgatgatacaaaaaatgttttataaagcagcttatggtttcatgc

SEQ ID NO: 19516 - DNA, 192 bp, Homo sapiens
attgattcttatgttctctcaggttgaaattctacagttgtattcattttataacatctgaccaatggcctaaagttgaaacaggccttgggaaatctctctctctctctcttttttttttccctagtgaaattgaactgaacctggaacctgggatatttcttgctgtcagatttattcagttcctgtcct

SEQ ID NO: 19517 - DNA, 188 bp, Homo sapiens
gggagacattatgtttttcataaactgttgaaaatgcttacaaccttgtaacagtctcatcaatcctgttataattaatactgcaggtatataaaaattgagtggattctcaatttttttggattcccaattcctagttgggtggatggttagaaagatgcctataggattttctccttgcaaaaaaa

SEQ ID NO: 19518 - DNA, 357 bp, Homo sapiens
gggagggcatagtgaggatagctggacagtaggagcccagcttcacctcctgcatgaatgaggaccctggtcagaccgtctctgaggctccaccgctcctgatcctgaggggaatgtgttgaatgaggaccaggccacagcgtggacagtgtggttgtagctccagcgctgaccctacttgggctagtgggagggcctggctgaggggaatcaaacagtatcctttgtggtgattcggccaggctgggtcagagaaagagcttggcttgtggcaccagcaaggccctgactctgcagctggtcttttccatttctgtgctcatgcctatgaggctgggtccaggtggcacctgctag

SEQ ID NO: 19519 - DNA, 333 bp, Homo sapiens
aactataattccagcattttggaaggccaaggtgagtggatcacttgaggcaaggagttcaagactagcctgggcaacgtgacaaaaccccttctctacctggtctctaccccgtttgtacccatctctaccccctctctactaaaacacaaaaattagctgggcatggtggcacacgtctgtaatcccagctactcaggaggccaaggggtgagaattacttgaatctgggaggtaaagcttgcagtgagccgagattgctcccctgtactccagcctaggcaacagagcgagactctgtctcaaaaaaaaaaaaaaaaaaaaaaaaagatg

SEQ ID NO: 19520 - DNA, 293 bp, Homo sapiens
ttaaaggatcctgataaatgatatcacatggaagctgtcagccaaatccacaaaaggagtgtctcaaacaaattaatatggaaataaatcaaaagaagagggagaaaaaaggagggagtatgttgtacattaagagagatttcaagagcgataagaaccaaatgtattctgtaaacttcatttaatcctaacttgaacaaatcaactgtaaaatgacgtatttgagacaagtggggaaactttactatattagatgacagtaaagaatgtattaatcttgttagatgtgatat

SEQ ID NO: 19521 - DNA, 153 bp, Homo sapiens
gatgaaaattgttctaaaattagtttgtggcgatggctgcatagctctaaatatacttaaaaccattggattatatactttaaatcggggactttaatggtatgtgaattatatctcaataaaccctttttttttttttttaaagaaatgtga

SEQ ID NO: 19522 - DNA, 144 bp, Homo sapiens
gaagcacttgttatgctcctactggggaaaccgtcctgagcctaagcatgatgctccaatgcttccatgcttcgagggacacaaaggtgattcagcccacagcccttacacccgctgccttagaagagcccacaaaggaacaag

SEQ ID NO: 19523 - DNA, 254 bp, Homo sapiens
actagtcactgactgctgtgaatgggttttttaatcttctagccctgaggccatggtcactttagttccaagacgttacacagtaacgtgacctgcttttacgacaaggtagtaagaggaaggcagagggaacactgccctaaaaacttcaataagttaccaccttcagctgggatctgggttttaagttttttctctagttgtttccatagtttgacttactaggaaataaattcagaggatgctgacactga

SEQ ID NO: 19524 - DNA, 472 bp, Homo sapiens
tttttttttgagacagggtctcactttgtcacccaggctggaatgcagtagtacaagcatggctcactgcagcctcaacctgtcaggctcacgcaatccaagctatcctcccacctcagcctcttgagtagctgggactacaagtgcctgccacatctaattttttgtattttttgtagagatggagttttgccatgttgcccaggctggtctcgaacttctgagcgcaagtgattcatctgccttagcctcccaaagtgctgggattacaggcgtgagctactttttttttttaaacagataatcaacagggccaaagcaattaagtcattttcccagtcacttggccaataagcagcaagtcaatgaccagaacaaattatacaactttcatcttcccataactgatctaagcctaccaaaaaaacggatgagactagacagaagaaacagtgtcaccttcatccccggt

SEQ ID NO: 19525 - DNA, 866 bp, Homo sapiens
tttttttttgagacagggtctcactttgtcacccaggctggaatgcagtagtacaagcatggctcactgcagcctcaacctgtcaggctcacgcaatccaagctatcctcccacctcagcctcttgagtagctgggactacaagtgcctgccacatctaattttttgtattttttgtagagatggagttttgccatgttgcccaggctggtctcgaacttctgagcgcaagtgattcatctgccttagcctcccaaagtgctggggttacatgcatgagccaccatgcccggccatatatcctactattctttaagattcagttcaagttccatccgtgtgtgatgtctccttgaccactcactgcacaattctctccctcatatgcatattttattttccttccaatagatatcctgtgttaattatatgttatcatatcgctaatttcccagttacatatatgacatatctcttctagaatacaagctttgtgagaatataatgtatggcaaatactttctcatatctcccatacaccaaatacagccttacatattctgctatttaaaaaacatcaaactggccgggtgcagtggctcacacctgtaatcccagcactttcggaggctgaggcgggcagatcacccgaggtcaggagttcgagaccagcctggccaacatggtgaaaccccgtctctactaaaaatacaaaaattagctgggcgtggtggcgggcgcctgttatcccagctactcgggaggctaaggcaggagaatcacttgaacccgggaggcggaggttgcagtgagctgaaattgggccactgcactccagcctgggtgacaagagcaaaactccacctc

SEQ ID NO: 19526 - DNA, 893 bp, Homo sapiens
tttttttttgagacagggtctcactttgtcacccaggctggaatgcagtagtacaagcatggctcactgcagcctcaacctgtcaggctcacgcaatccaagctatcctcccacctcagcctcttgagtagctgggactacaagtgcctgccacatctaattttttgtattttttgtagagatggagttttgccatgttgcccaggctggtctcgaacttctgagcgcaagtgattcatctgccttagcctcccaaagtgctggggttacatgcatgagccaccatgcccggccatatatcctactattctttaagattcagttcaagttccatccgtgtgtgatgtctccttgaccactcactgcacaattctctccctcatatgcatattttattttccttccaatagatatcctgtgttaattatatgttatcatatcgctaatttcccagttacatatatgacatatctcttctagaatacaagctttgtgagaatataatgtatggcaaatactttctcatatctcccatacaccaaatacagccttacatattctgctatttaaaaaacatcaaactggccgggtgcagtggcaatattttatcttttaaacaaaactgagtgtgtctggggaatacaactggatattcatacacaaaaacatataactgcacctttacctcacacatacacaaaaaccaacatcaggaagatcaaaaacctaaacatgaaaagctaaaaatgataaaggttctaagaaataataagagacatatcttcatggtctcagagtatccttaaaaaggacacagaaagcactgaaaaaaattggtaagtctgactacattaaaattaagaatttctattatcaaaagggtaccaataaga

SEQ ID NO: 19527 - DNA, 394 bp, Homo sapiens
gtgcattccctcgcggcctcaccagctgccttttagtcttttcattaattacccacagaaaaagagctgctacacctttgtgtttccttgctggtccttttagcttagtttaccctttttatgaggtgttggaatgaggtcttttctcaaagagccagttcagcctttcgtccctaaggcccagcacactatttagggcagcaaattattcccctttacaaaatgcaggatttcacatgtgatcttaccatctaggctggcttactctgattatttcaggccataagggccttaaaactgcctctctgtacaagttaatgtttatttgtttaaaaacattaaaaaaaatttgtatcgtggtaaaatacacataacacaaaatttaccgtcttaa

SEQ ID NO: 19528 - DNA, 261 bp, Homo sapiens
tctgattcttttttaaaagtttttaaataggagcagtgttcccttcagtcaggaaagatttctgaaaatatcaaacatattcttatcaaactcatattcccaggtgataattactctacagggcagtgttcaccaacttttagttccagacatttgagtcctttgcttagaattgtttctactttccctggaagacagggcaactgatgagcacgcttcctggagtctcacaaattgcagatctggccctggcactgaggc

SEQ ID NO: 19529 - DNA, 382 bp, Homo sapiens
atacaagtagccataagacttactggcctggtgtgtggagacttcagaggaggtagggcaactcttctaggtgccatgagcaagccccattaaactaaagaaatcaaatcacctcattcttaaagtcttgagaagatgagataaacttaaaagctttcaactgtgaaagaacagaaacaaagctcgctggagagatgggatctgaatagtcaaatcattttgaataggcactatgtacttgggaacttctgcatgagcaagtgattcttggatattcctgtaaatccattctgaatatggtaagtaatactgaagaataactgttttcgagtgctttatctgcatgtatcaaaataaaaaagatttgtgccaatgtgcattt

SEQ ID NO: 19530 - DNA, 351 bp, Homo sapiens
ctcattcatttgtgtcagtgaggactgaggaatgatgagaattaaaatcatggccccattaaactaaagaaatcaaatcacctcattcttaaagtcttgagaagatgagataaacttaaaagctttcaactgtgaaagaacagaaacaaagctcgctggagagatgggatctgaatagtcaaatcattttgaataggcactatgtacttgggaacttctgcatgagcaagtgattcttggatattcctgtaaatccattctgaatatggtaagtaatactgaagaataactgttttcgagtgctttatctgcatgtatcaaaataaaaaagatttgtgccaatgtgcattt

SEQ ID NO: 19531 - DNA, 317 bp, Homo sapiens
gatgtaacatacatagcagtatgctagcaagagagtgattttgtgatagcttcattttatggatatcaatcctgattactagtgatagactaccataacccaagattcttttcaaggtcattgccatgttgatgctttccttaatatatttacttttcctaaagaggagtggtgtccttttatgtattcatttgtgtgtgactttttaaataagtatctcttaaaatctatcagaatgttctctcatatgtgtggactagatagattgcattcagaaatgccattttagatctgattattaatctaaaggggctatg

SEQ ID NO: 19532 - DNA, 1545 bp, Homo sapiens
gaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatat

SEQ ID NO: 19533 - DNA, 1597 bp, Homo sapiens
gaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaaggtagaagagtgacaaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatat

SEQ ID NO: 19534 - DNA, 1543 bp, Homo sapiens
gaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaaggtagaagagtgacaaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttctagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatat

SEQ ID NO: 19535 - DNA, 1543 bp, Homo sapiens
gaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaaggtagaagagtgacaaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatat

SEQ ID NO: 19536 - DNA, 1544 bp, Homo sapiens
gaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaaggtagaagagtgacagaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatat

SEQ ID NO: 19537 - DNA, 349 bp, Homo sapiens
ttcttttccctgattaggactccacagttgtaattcagaaaatactaaaaagttagtggggaagataagagcatttactataggaaacggatttcaaagtgtacttgatttaaagatttaagcacaatagaaaagcctgggcaacatggtgaaacctcatctctaccaaataaggaaaatacgtaaattacgtgggcatggtgggcatgcttgtggtcccagctactcaggaggctgagatgagagaattgcttgagcctgggaggtggaggtttgccatgagccagtatcgtgctactgcactccagccttggcaacagagcgaccctgtctcagaggctagacatac

SEQ ID NO: 19538 - DNA, 592 bp, Homo sapiens
aagtggaaagaatgatagacctgaatgagacttttcttcagtagcaggggataattagagacaataaaacaatgctttgagaggagaaattactgtaaacatagagttattgatccagcaaagctatcaagtcagatacaaggtcaagagatgacaattttagagacccaaggattcatgttgcatgcaccctttctgaggaggtaatttgaagatataatacagcgaaatgaggatgaacatcagaaggaagatttcctagtgcacgacaaccaagaggacagctgtgtagcaggctggaaaatgtattccatttagaatagaaagttggctggctgtaagaatttcttaaggaaaagtcagtttcattcagtagtgggtagagtgagtaagaagcttggtggtatggaaaagggtcttctgaaaaagaaaaagaaaaggcaatcggaaactccatgaaaaggggtgagggagtagggcaaagaaagctgtagcctgaaaaatggggcctaattttgacagtattgaaagagagagcttctttgacctgactctgggaagattttctccttgcagctcctatgttgtatac

SEQ ID NO: 19539 - DNA, 310 bp, Homo sapiens
agtcaagatgcaggacactttagtcatcacaggaatccctcatgttgctcttttgtagccatacccacttccctcataaccccactccctccttaatccgtggcaacctctaatctgttctctatttctataattttgccattttaagaatattacataaacaacatggaaaccttttggatttgacttttttcacttagcataactcctggcgttttccaggttcttgtatgtatagtttgcaccttttcctttttcttttttttttctttcttttcttttctttctttctttcttttttttttttttg

SEQ ID NO: 19540 - DNA, 367 bp, Homo sapiens
ttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagaccctgtttcaaaaaaaagaaaaataaaagaaagaaagaaatgaatagataaagatgaccttttgagaatcaacaagacttggtaaactaatattttggcatggggcaaggtcacagaagg

SEQ ID NO: 19541 - DNA, 246 bp, Homo sapiens
tggcatttgtttatttatttattttacagacagcatcttactatgttgcacaggctggtcttgaattcctgggctcaagagatctgcccacctcagcctcccaaagtgctgggattacaggcatgagccactgccaaatttagcatttcaactgagggtttcacagataccctgaagcttctccctgccctcgctttcagaaaactcatagatccccaaactaaagtaactggtcaaggaggtcaa

SEQ ID NO: 19542 - DNA, 342 bp, Homo sapiens
ttttttttttaaatcacattgtcctcactctattcctgtctactatcagctttaacatgaaaaatattttgattattctccctgctttcaatgtacaccccttcaatcacagagacaagagtgcccagttttaatataaaccaactcgtctcatttgccagcttggaagtctgatgtgatttcctgatttcttaatgtggcttacaaagtcttgtgagatttggtatctgtcattctctcctttctgatctccttctctcttttgttctaggtctcaggcatattgctactttaattccttgactatataatgttgcttcccactttgagggctttttccat

SEQ ID NO: 19543 - DNA, 1353 bp, Homo sapiens
ctgatacaagaaaggagactccagcactagtttcctcagtccttctgcagggcgggccttctcacggcctcaaagtcatggagaagagtgtgcacaggacacctcactttaagcaaagcccatagaccgtatttgagaaaaggagttaaataaagaggcagccaccaacaaaccagagccctgtggtcactcaggtcccatagactctagaggtcaaagggcctccgagcatttgagaatcagagagggcaagtaacttggctgatatcacatagcacgaaggtggcagagccaggattccacctgctggcctcccagatgtctttcctgttggaccctgcttgctggccactcctggtgggggtcactccaccattagtgtgttcatcaaactgacagttgtggtccagatcccttgcctctggtgtgcccagcaccttagctggcacctccctcagcaaacccagccttcgccatcctcccaagcatacttcccagggctgttttgtccattacggtcccagaatataaggcctttgggttttttcagggcctgtgaaaaggtttgaaaaatgaaaaacacactggcagttccaaaattctcaaataaaactgtagaaatgccttaggaattaaatatgtaataagatgtgaacacttcattacacacctacaattagtcacatgcctacgatatgtgaataatgtcaggtcagctagtgaactgttatacagtaattgcgcatcacttatatagatatacacaaagtgcacttactgacttggatgtgtgtgttcattgtttgaagtggcgtggatggaggctccaaaagataacaagaatgtaggggaggtgactcttcaaatggccctcacccaccccttaccctcagctcacccaccatgaagcttccccttccaaggaggacacacctcctttcctagaacattcttcagtgccacaagctgctcagtcagccctgattctggagtctccagtgagcgaggcctggggtggccccagtgggatgagccacactccccacagcactcagcctggatgtggcactggctgcacatagcaagaggcagctattggacacctgctcgccacatgttctgtcttatcctcccagcaacaccgagtgagggagggagtgttaacccaccattcaccaggtttaccagagaccaagcccaggatctctccactgcacacttttaaaagggtcctttcagcttcccattaaagaagtttgttcctttgttcctcctctcctgttcttcctaagacatcatcactgaaatttaagcttataaatttaaaatgaagtaaatctataagggaaaagc

SEQ ID NO: 19544 - DNA, 576 bp, Homo sapiens
attcatcattaaagaataaatagtatcaggattaagcagcaaagctcacattgcaaaaatattgccaacagttaactctctataaaagccaattcaaatacagcttgggaagtaggtcaaagctggaatgtacatgaagacatctatgatcccaaaaggttccaggaaatctagtattaaatctctcttcatcaatggggtacataagttttgaaattactgaaaaaaaaaaaaaaaaccaactgggtatacttcacaaaaatatttccattttgtaaatttttctttcctttaatttttcagaccaggcagaaacagctcttcctcaactacatatataagaaatcaaagcaaagaaccagttttgctatcttaatgtatcacaattttagtattaaaagctgtagttcattaaagaaaaaaaaattcctgtaaggaaaagcatatgcatcaacaagtgtgtacaagacactgcagaggataaaaacatacataactgtccctatcaaccaacaggggatgttatactagctgtcgtgaactgggattgcggatacgatgtcacacagaacagct

SEQ ID NO: 19545 - DNA, 788 bp, Homo sapiens
attcatcattaaagaataaatagtatcaggattaagcagcaaagctcacattgcaaaaatattgccaacagttaactctctataaaagccaattcaaatacagcttgggaagtaggtcaaagctggaatgtacatgaagacatctatgatcccaaaaggttccaggaaatctagtattaaatctctcttcatcaatggggtacataagttttgaaattactgaaaaaaaaaaaaaaaaccaactgggtatacttcacaaaaatatttccattttgtaaatttttctttcctttaatttttcagaccaggcagaaacagctcttcctcaactacatatataagaaatcaaagcaaagaaccagttttgctatcttaatgtatcacaattttagtattaaaagctgtagttcattaaagaaaaaaaaattcctgtaaggaaaagcatatgcatcaacaagtgtgtacaagacactgcagaggataaaaacatacataactgtccctatctccaaacagtttataatctatatactgtctctaaggtatttcatataactttaaagctttttaaaactttctctcaaaaattaagcctgactacttaataaaatttccttttttttcttttaactaaaagtaaaatgagaagaaagccgacactgtggcttgtgcctacaatcccagcaacttgggaggctgaggccagaggactgcttgaggccaggagttcaagaccaccagcctgggcaacacagcaggatccctccatgtaaaaaaaatttaaaaat

SEQ ID NO: 19546 - DNA, 396 bp, Homo sapiens
aggggttgtgtgcaagattggagttcataaaaggatgtcacccagggtgcagagttaggatatttctgggtttggtgacttaggaaaaaatatgaggaaaatctgtttcgctttaagggttggagtacacttactaagagcatcagagcatttatttcacaagggggtattgtcaaacttaaatgcatacatcacagtagccaaaacctatgccatcacaataaaaattcatattaaatgtttttggatattcattaagcccttatatttcttaatacaaattatatgcatatgcccatacacattaactgtaatgggtttttctttatatattttcttgcacacctttaatactatagcaaggtgttcaatttttggatttaattatactctttt

SEQ ID NO: 19547 - DNA, 191 bp, Homo sapiens
cttattcttcttcctccttctgtttttaaatgaggaagcccatagaaaatattgtgacagggagaaatggattttaaataagtatgactgaaaaaaaacttttactataatagaaaatcttggtgctgagggaagaaatccaaaaaattaaaaatcttcagaaggtatgtctttgaacagacaaacattca

SEQ ID NO: 19548 - DNA, 299 bp, Homo sapiens
accaagtacagatggactgagtacggcctcacgtttacagagaaatggaacaccgacaatacactaggcaccaagattactgtggaagatcagcttgcacgtggactgaagctgaccttcgattcatccttttcacctaacactgggaaaaaaaatgctaaaatcaagactgatgaattccagcttcacacaaatgtgaatgacgggacagagtttggcggctccatttaccagaaagtgaacaagaagttggagaccaccgtcaatcttgcctggacagcaggaaacagtaacacgcg

SEQ ID NO: 19549 - DNA, 594 bp, Homo sapiens
gctggagcccaggagttcgagaccggcctgggcaacatagcaagaccttatctctatttaaaaataaataaataaataacatctcttacaaaatcctgtttactattatctccatattgcctagccattgggatctgaagctactgaaggggggagaaatcctagccaattaaacaattcttcaaaacaaactaaaatccttaagatataatttataactcatttcaactttttaaaatacgggcattactgacatctataaacaaaggcaagagaggaaggtgcagatgaagtcccttttcaaatcaaacttctactcaaatcagaattggtaaaattgttttagaattcttaaaataaagtttggtgggttttttcccccagaaacctgtgtgaggtcagttccatcaaaagtcatcatcacccctgatcacctcctcagacatggggaatctcactcagctgagaccaacagttggaggaggtactggtcccattggtacagatggtcacagccctttaattgaggtcagctgacttgcttagtcatatgccacctctctcaccaggtccaccacaggacagtaatttctc

SEQ ID NO: 19550 - DNA, 377 bp, Homo sapiens
tggtaacattgatttctactctatttaccagcgtttctaattggaaaagctgcattatacgaagttaaaacatttacagtggttcctcagggcttgcagcctgacaaataaatctccttcgctcccgacccttctatttctgtctcctttcagaagtgttccacacatattcgagtagatttatatagacgtgtgttaatatatttcttactccaccccattcttttaaaaatacaaatgaaaacgtaatagtgttacgtgccccttttctcactcaaaaaaaaaaaagtatatatttatggagagcatgagaacaggtaagatttagtatataggtataatcatcttttattttattatgagggtcaaaatggcat

SEQ ID NO: 19551 - DNA, 458 bp, Homo sapiens
gtttccaaatatgggtctccagactctcagctgattctgtgagcttccttcccttcagcaaagcgatttctgacctttgtttctgaatttgctatgtgctgtttgtttgacaggtctagtttatattttaacaaggaatcggaggttcccaggtataataaactacccaaatttgcacaacaggtgcatgtctaagaagaattttacttccagttcattggcttcaaaaccggtttttattttgtattactaaatcattttcaaaacatgttttcatattattaatactgtggaatttgcgagccactcatcaataatgaagttaccaactaacagagataggagagccatgtcagtgttctccagccaaaatccaactgccacattctttgttacctctcagcaaacagaacggactgctttttggacatacgtcattgtgatttctttgtactggt

SEQ ID NO: 19552 - DNA, 378 bp, Homo sapiens
aactctcatctccctgagacagagcacctggggggaggggcagctgtggtctcaggttaagcagtcctacctgctgactctgaagagtctgggcgttcagaatgagggcaattccctgagcacagatcaccagctccaccaatgggcagccagactgcttccttaaggacgtccgtgatactgtgctttttgtctgggtgagacctcccaagtggggttagtagacaactcatatgggagagttccagctggcatcaggttgctgcccctctgggacgaagcttccagaggaaagagcagacagcaatctgctgttctgcagcctccactggtgatacccaggcaaacggtctggagtggacccccagaaaactgcag

SEQ ID NO: 19553 - DNA, 133 bp, Homo sapiens
taatgggcacaagggagaaaaagccacctagagacagactctccccttaatgaagtattcaagcacagggaacccttgaatgtgttataatacatgagcagaaaagatcctgacttgatcctaattagcgtga

SEQ ID NO: 19554 - DNA, 207 bp, Homo sapiens
tgctgagttagaactatatccctggagcagtggttttcaagctggagtaatcagggttgtagacttccaagggatacacttgcacgtctagcttaacatgaatacatttccagatcctcagcttcccagtgaacttttttttttttttttgagacagagtcttgctccgtcacccaggctggagtgcaatggcacgatcttggctca

SEQ ID NO: 19555 - DNA, 665 bp, Homo sapiens
tatttttttttagcaacacattcaaatacaagcatctcaccattcattacctgaggcctttaacaatctccttagatctgcttcctcccaccaaagctaaatatcctaggactgaaaaatacaattgttttgctaggtagacgagctcttttctagaaactcctcatttgaccatacatgagaactcatccttgacatgtgcagagattcagcagggacccgaaataggagcaaggtggtctgccctatcactctgccatattaacttctctacattccactcatttcccatgatgaaatgaaatgatttctgaacacctactagtgccaggttctgtgctaggtatattacagactttacccctctaattctcactacaatacccttctaccagtgagaaagagtgaggttcaaagaagttacaaaaactggtccctagccatacatctggattcaaacttgggtcccaccgagagtggtactctttccgctgcaccacactgcttaccaagacatggagcacctcagggcacatccatggaaattcttaggtgccatatatatgtgtagatagcataaaccattatccaacttcaacaaatttaaaaattaaaaatctgggccaggcgtgttggcttcagaatggtggggtctctagagtcga

SEQ ID NO: 19556 - DNA, 1909 bp, Homo sapiens
attggtccattttacagagagctgattggtccattttacagagtgctgattggtccgttttacagagtgctgattggtctgtttttacagagtgctgattggtgcgtttacaaacctttagctagacacagagcgctgatttgtgcatttacaatcctttagctaggcagaaaagttctccaagtcctcacctgacccagaagcccagccagcttcacctctcattttgatcaggagccaagacagtggtcctgccaaatacacgggtcctgttttctgtttgaactctttagtgctactcatccttcaagctatttcctatactgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttcctaacagacagcttaggggcagccagaggctctttttccccctcctttcttccactcatcctctgaatatctcctcatctttccagaaaccactcaatgtccattgtattcttctgctgcccaactaggaggaaatttctacttctttctctgagctcctttagttctttgcatccttgattctgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacatttgctgtg

SEQ ID NO: 19557 - DNA, 1774 bp, Homo sapiens
attggtccattttacagagagctgattggtccattttacagagtgctgattggtccgttttacagagtgctgattggtctgtttttacagagtgctgattggtgcgtttacaaacctttagctagacacagagcgctgatttgtgcatttacaatcctttagctaggcagaaaagttctccaagtcctcacctgacccagaagcccagccagcttcacctctcattttgatcaggagccaagacagtggtcctgccaaatacacgggtcctgttttctgtttgaactctttagtgctactcatccttcaagctatttcctatactgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttcctaacagacagcttaggggcagccagaggctctttttccccctcctttcttccactcatcctctgaatatctcctcatctttccagaaaccactcaatgtccattgtattcttctgctgcccaactaggaggaaatttctacttctttctctgagctcctttagttctttgcatccttgattctgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacatttgctgtg

SEQ ID NO: 19558 - DNA, 689 bp, Homo sapiens
cctccttccttccttcactccttctttcatttctccttccctcctttccttccctccttccttcctttctttcttccttcctttctccttccctccttctttccttcccgccttccctccttccttccttccttctttccttcctttctttccttttatttcttccctccttccttttttccttccttttcttttctttcttccctccttccttccttccctccttccttcctttctttttacagtttcctgcatttcaccaacttcccgcaatgacatctataagacacaaaggtaaagagcttggattctgagccagaatccccagcttcaaatcccatctccactacttactacccatgtgtgtggggtgcgcggcggaaggggtgggcggggcagtgttggaagtagaagttgcttaacctctcgaagccttagtggtctcaacaataaataagattgttgggaagatgggatgcaatatcctaatcaaagcacccagaaccacggctggcatgaaatcagcatttgccacaaagacaattccgattgttaaaataccaaggcaagcccagagtagtggttcacacctgtaatcccagcactttggtaggccaaggcaggcggatcacttgaggccaggagttcaagaccagcctaggcaacatggcgaaaccccatctctacta

SEQ ID NO: 19559 - DNA, 749 bp, Homo sapiens
cttggcctgggatcgcctgagggccctgtgaagcttcagagcagtgcctgaaacactctgaggacagaaactcagggaccaacacacctgtttccacagagctggcccctgcctctgcttcctggaagcactgcaagagtgcctgcagttatagccgggagatgaccacagtgagaagccagagaagaggtaaacagcaaccttgggcaagcaggaaggcagaagcagatgcttggaaccacccagaggttttctaccacagaatgtgtaactttgattttcacacacaaaatggtctcaacagtggttgaaatatacaaaaacagaaaccccaatccagcccttagcctgatgctctgcatgctgttaagaagggggtgttgaatgattccatttatttgaaatacccaggagagggagaaggttcatttgagaacttcccctgctgaagctttccctgaccctctgggaggggccggaccctccgtctgtggtcccacaacccctgaggaggaggaggcactcatcaggtcccttggcgccttgcagcccttttcttgggcctgccttttacctccatcctccactccactgatggctcagagcccagaatcctgtcttcatcctggcaacagtcccttcagggcccagcaggatgggggaatgaataaatgtgcctgtttctgaacataatcattaaattctttacctgtaatgtggacattaaaggtgaatcatttcccccctta

SEQ ID NO: 19560 - DNA, 2840 bp, Homo sapiens
  misc_feature (2728)..(2728): n is a, c, g, or t
  misc_feature (2745)..(2745): n is a, c, g, or t
gcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgccttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatggtgtgtatatgtatatatcacaaagttgtattttaaatattttaaataccctttcttttaatttaagggatgtcaaataaatgaaaggagtttaaaaatagccaaaataaatgagctataaaggcccataacatactaaaacaggcagtttcaggtatgtaaggaaaggaacattatacttacctagaaagtgagatctaaaaaaaaattaaaaataaataaaaaataaaaaagaaagtgagatcttggctatggctggaggtcagtcactttatggcataaattatttgggaggtaaaaagactgttttcaattcaaattgtgcatttattggcatctaaatctagcatgattttggttagagcacaaaagaaataccacataataccaaatcacagcaaatgttagaattaatacaacaaaattttcctttggctagaaatcttatgttatacctgaaaaattggttttaaaaaatgttcatcttggccgggcacggtggctcacgcctgtggtcccaacactctgggaggctgaggtgggtgaatcatgaggtcaggagttcgagaccagcctggccaacatggtgaaaccctgtctctactgaaaatacaaaaaattagctgggcgtggtggcaggcgcctgtaatcccagctnctcgggaggctgaggcnggagaatctcttgagcctgggaggtggaggttgcagtgagccaagaatgcactactgtactccagcctaggcaacagtgcaagactccatctctg

SEQ ID NO: 19561 - DNA, 2532 bp, Homo sapiens
gcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctatttcccaggaatgattgacactttggtgctggggttttgtgggggcggggggtagtttttgtttagcttttgtggagattgtgtgtgtgagaggagatttgatttttttttcttcttttcctttgtgagctgatggctgaagtgtaacagtacatcttcaggtaaagagagggatttctcaatctactttctgttatgtcagactataagagaaaccctttcagctgctttctagatgtacctaaattcagtcagacattttggattaagaaacctaaagtcctgatacattacatactccaaggaaatatatcagggacagacaattggctgaaacactgatacttcaatgtgacacatttttatagaacatttctaccagggggtactgaccttgatttctcctacaaggaccacactgcctttgtgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgccttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatgccgtgtctcctgtcctcttcttactcccacccctctccgcactctcacacccctgtcctctcaccctctacatcgcctctcccggccctgcccctctcctcacactttctcgctttcctccctctgcccacccttcactcctccctcaccctctcctctctcctccctctcctcctgcctctctcccctccctcccttccctctcctccctcctctccttacctcccccccatcctctccttctctctctccctctctcctcgtctcctcactctctattcccctctccctcctctcctctccctcctcccctccctcctcctcttcttctgctctccgtccatctctccgccccactacccctccgtcccccctctcctctcctctaccccgtgacgctgttcttccccctctcgtcctccctatctctctctcccctctcctccttcctctctctccccg

SEQ ID NO: 19562 - DNA, 390 bp, Homo sapiens
tagagagatgtgtggaatgaagtaagtgtgcagtaagtgttaactacaaatattattatcttagacatacagatttccatgattcatgaatggtgaagcatcttagaagacatccattccaggccaggcatggggttgcgcacctatagtcccagctgctcagtagaatgaggcaggagaattgcttgagcctaggagtttgaggctagtatgggcaatatggtgagaccctatctcaagaaaaaagcaaaactttttttaaagtttaaaaagagagacatctgttccactactctcatcttagaggccagaaaactgaggctcagataatttcagagactttcacagatcccccaaccatttggtggcaaagccaggaatagaactctg

SEQ ID NO: 19563 - DNA, 165 bp, Homo sapiens
cgttgagatgggaagcgggatccggggttcgaaataaagccattgtagctaaaacgtggagcagtcaggcgagggaaggcaaggaaaacagcacttaaaagatttgaagacaaacctgcaggactcggtagtcatttagaacagtggttctcaaaatgtggttcc

SEQ ID NO: 19564 - DNA, 451 bp, Homo sapiens
ataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaac

SEQ ID NO: 19565 - DNA, 256 bp, Homo sapiens
gatcccctgaagtcaggagtttgagaccagcctggccaacatggtgaaaccttatctgccgagaccagctcggtcagggagaccctaacccagcagtgctagaggaattaaagacacacacacagaaatatagaggtgtgaggccgggcgcggtggctcacgcttgtaatcccagcactttcggaggccgaggcaggcggatcacgaagtcaggagatcaagaccatcctggctaacacggtgaaaccccgtctct

SEQ ID NO: 19566 - DNA, 500 bp, Homo sapiens
ggcacagtatgaccatggtatatatacttaagcacaaatggcacatctctgagactaggccaaattcctaggaagaaatgagcagcaacaaaaatcctacattttcattaagtgctaagtatcgtctgcaactgattttcctgacagatctgcttcacatttctgtgtaagcaaattatgtttaaaagctgggctgccatccattatccttcccaatgccccaggcaaggctgatctcttccacatatcactcctcatcattaatgtttgtaactgcaagtaattctagcccatgcagtgacagggaagcaagatagagcagagaactcaatgactggcctgctttctcaataaaaggcaagagattctccgaatctcttctgcagaaaggggtaggagtcaattctcatcttttctcatgtgttctttccctctgcaatatgctgagaaagtagagaacagatagaaagggcatgtgtgtgagtgacatattccttctt

SEQ ID NO: 19567 - DNA, 305 bp, Homo sapiens
gtcatgctctgctaatgtctcttttggaccaggcttcaagcttgctccacccccagctttggcttgcccagcccagccttagcaaggaattctgctaagtcatctcccaaccctagatatctaattacccttgatatctgatcaagttcttcatcctccacctttttgatgtctaagtccttggactgcctttagcaagagtcctgttaggccagcttagcaagaattcccctgcccttgatgtgttcttttagcaatttcccatcctttgacatcctcatgctgttcttggctataaatcttca

SEQ ID NO: 19568 - DNA, 498 bp, Homo sapiens
gtaggcaggttgccccttctactgtggtgtcagtagaggccgtatcaagggcaacaatgaggcacccctttttctctcagccagggaggtttctgtggaagcctagctgggagctagaactctcacccttgctcagcagtaacgaggagccctccactctgcagtgtcagtggaggctgagtacggaacctggactcctacccctacctagaagtaatgaagtagtgctcctcttctgttggagcagtgtcagagaaagccagcttaaacaaagggtttgaataagatccagggtcttaaaacataatgccccaaatgtgcagattttaatgaaaaatcacttgttatactaagaatgaggaagatctcaaactgaatgaaaaaagagaatcaaatcaacagatgtcaaaactgagatgatagagatgttagattttaaagaagtcctcataaaattgcttcaataagcaattgcaggtatgcttgaaacaaacaatg

SEQ ID NO: 19569 - DNA, 557 bp, Homo sapiens
ctactgagtgcctcatatgtgccaagcgatgtgctaggttctagagatacagcagtaagacctgccttgatgcagcttacagtcttacagggcacatagccattgaacaggtaatatatctcaagggatccatcgcaagtgcaccaaatgtggttaagcgggatgctacaggagtaggtcagcaggcctgacctacttcccaatgggtgaagaggaagtctaaagccaggggttctcaaaacatggtccttggaccagccatgtcaccatcacctgaggacttgctagaaatgcatattcacagtcccaccccagacctactaaatcaagctctggaagtgggcccaagcaatctgtttaatttgattttgatatacattaaagtttgagaaccactggcctacagaaactaacatttaagctgagctctaaagctgcatgatctagtgcggtagccactggtcacatgtggctatggagcacttgaaatgtggctggttcacattgagatatgctttcattataaagtacacaccagattccaaagacatactgtg

SEQ ID NO: 19570 - DNA, 391 bp, Homo sapiens
tgattgcattgtttatgagagcgttttatttccctaataattaattttacatattaatgtttaaagctcacattgtacattatgtaacagagttgaatatttacacttgtctccacttgactttaatctttttacatgagggatggcaattgtatgtccacgggtaaaaataagattgaaatgtattgcatagtggcttgtgcctgtggttccagcacttcggaaggccgaggtgggtggattgcttgagctcaggaattcgagaccagtctgggcccatctttacaaaaaatacaaaaattagctgggtgtggtggctagtgccagtagtcctagctactcaggagaccgaggcaggaggatcacttgagcccaggaggcagaggttgca

SEQ ID NO: 19571 - DNA, 420 bp, Homo sapiens
gtaaactccctcctatctaacatggcatagtgtgacggaactatagagaagaaaactggttcctactgtaaatgctgaagctgtaaggagggctctaacacccagatcctaccaggatgcttcatacacagtttcccaaccctcaaacagacctttggatccatcttgcttatgaatatcaatgcaaatgtcctaagtaagttattggtggagaatctaacaaaacactgaaggacaaagtaaaatttattataaggcaaggatggtttgacaatagagaatctattatataattaaccatattaataaattcaaaatattatccaggtgtctcaatgaacatcaaaaaggcaactaatagtatttaacacccattcttgatttttttaaaactcacaataaaataatagtacatggata

SEQ ID NO: 19572 - DNA, 374 bp, Homo sapiens
gaaagaggtttaattgactcacagttccacatggctgaggaggcctcacagtcatggcggaaggcgaatgaggagcaaagtcttgtcttacatgggggtggcaagagagcttaggcaggggaactcccatgtataaaatcatcagaccccatgagactttttcactaccatgagaacagtatgggggaaactgccccgatgattcaattatctctacctcgccccgcccttgacacgtagggattattacaattcaaggtgagatttgggtgggaacgcaaagcttaaccatatcacagaataaagatataaagaaaatattttgtacaactgtacaatgtatttgtgttttaagctgtgtgattacgagtcaa

SEQ ID NO: 19573 - DNA, 125 bp, Homo sapiens
actggttaattccaccaaacatataaggaaacaataataccaatcttaaactctttcataatacttcccaactgattttatgaggccaacataaccctgatcctaaactatgacaaagaccatgc

SEQ ID NO: 19574 - DNA, 617 bp, Homo sapiens
tcagagaagaccttcaggccacaccacacctttgaacaaagagtagaagtttgacttctccgagagcagcatccacccaaaatcttggtagtaacagaacgatacaaggctgagaagcagcttcccgtcctggataaagcaatgttccttgtactggaccacatcaacctgagtgagctcatcaagatcattagaaggtccttccagctcagtgctaatcaagccttcctcctggcggtgaacagacacagcattgtagcagagtgagaaggatgaagatggattcctgtacatggtctgtgtctcccaggagacaattggaatgaaattgtcagtgtaaaactgaaaaaaaaaaaatgcatctattttagaatttttaaacctttaccaaggaaaaaataaaggaatgttacccactgagatcgatcagttcatctaatcacagatcgtcaaacagtagtgttcccacctaggagtgtcaggaagttgtgtttgtatttgaagcagaaaactgggctccaagtgagcacgttcagctttggaaactatgttatttaacataggctagcttgttttcagattttaaaagtttaaaaagaaaatactttgcattctaa

SEQ ID NO: 19575 - DNA, 495 bp, Homo sapiens
tggagccaatacaaaaacatggtctgtgactaatagaatctatttttccccttgctactcactaaatagattttttaaaaattctcccttcaactagcataggaagccactgacatcttcagccacttagtagccaacctgttaccataaggaagtgcatttacagtggggattctgttgagatcatgtgaggcggttgtgaaggcacgtttacaaccccaattgatggtagttacttttggtctttctcttcctccccatggggaagaaacagacaatgagtagagaccagaggaggaaaaagaagcaccgcaaaaaaggaatagagaacctaaaaggcacaaatagtgcccccccacccaaagccaaatgtgtgcctttgaggctaaaaaggtgactgaccctggtgttaacgttgtatattttcaataagctatattcagctgtctactccttgaatttcttcttagcaacttaaacacaaacgaggcctcc

SEQ ID NO: 19576 - DNA, 425 bp, Homo sapiens
gcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggta

SEQ ID NO: 19577 - DNA, 465 bp, Homo sapiens
tcacttaccttgtttaattgggtttcagagtttaatttcgaatgctttgagtgtattttccaccactggagacttagtgtccagagagtccttgattttctttaccacaattgggaaatccattagacactacaaatgtaggtacttgagtgcttcgagtatagctagtatttgtgatactcttcagggataacaagttctatgagttgtgtggaagaaaatagtatttagagcagtgcctgtgaggagatggttattcacagcaaaaatttatatatgtttgtgttgatagtttcagtagcaactgtcttcttggtagtatgaataggaagtactcctagtgttaatagtagataactagtggctctttatgtatatgtttaatttgtaagttagaaactaaagctgtggatatctgtgaattatctgaaatgctggggaccttaaaaaaaaaaccctcattaa

SEQ ID NO: 19578 - DNA, 825 bp, Homo sapiens
atgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatatgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatggctcca

SEQ ID NO: 19579 - DNA, 468 bp, Homo sapiens
gcccggctagtggccactgggcgacacctttatctgcccagacaacagcctccaccctcttcctcagccgatctcattatcctgtccacaaatgaccagacagagatcaatgcaacctgtccacggcacacagctctgcagggcagagcgggggcagagcccagagccctgtccatggagggagctctctgggtggtctcttcccttgccgtttcaattagaaagattcaaatagaaaaaaaaaagcagtcaccatcttgttcagaagtcaatttcaaatgtcccttctgtgatgtccctgtggctggggaaagttggcggtgaggcccagtcccctttgttcaaccccttgggatcccattccctgatctcctgaccctgatggcttgggatcttgattttgggggtgataaccgaagtcactgggcacacacagtgccgtggagccgcagggataccccaaagtga

SEQ ID NO: 19580 - DNA, 425 bp, Homo sapiens
gcgctaggcacacagtgttcccgaacccggcgggagggcctgccaagttcgcggcgggcgtgacgcggaaacgtagataatgaggcccagggcggggccggacgcactgccccgcgggctccagagctgcgaacgccccagagtgtgcagggaggcctgcagaaagaaaatgcggctgaggtccccgtgggacccactcagaggtgggccgtaaagatcccggaagggtggatggcattagataccacctagtactccagcaagggctgggtcaccgaattgggatctcggcctcttcttccagtctggggaaaagtgtgttaaatgctaaacatcagtgtttatcgagtgaggcccagcctgtctggcataatgatttttaaaatctacattcaaatattaaataaaaactcaacctccccaat

SEQ ID NO: 19581 - DNA, 387 bp, Homo sapiens
tggcacactatcagtacatgtgcttcggagccttgagctactacataagaagtctgacatgaagctgcagtgctgagaggcgacagggaaataaagatagttgcatgaggagcctcagatgtttgagtctttccagcccatgcaccagatacatgggggaaccacctttgaatagtttgactgtctgaaactacataatagatgcctagcaaggccaaggcaagcctgtaaattatgacagagaacagtacagtgattgttgcattttataccactaaatctggggttgttacatagcaatggaaatctcataggcctgataagttatttaaaatatttattttatatgaaaatataataaaacactatagatataccagtagtata

SEQ ID NO: 19582 - DNA, 238 bp, Homo sapiens
ggtaaatgttaggactggtaaaaaataaaaattcttacatttaacaacaggttacaaccataaccgcagttgatgagaataaactagattggaacatttgataaatatccttctgataatcttattttatgaccttaccagtaaaaagattttcgttacaagtattacagatacagtgtttttaatgagatggtctgtatctttaaaaactatttatgacctttgacttttctctgta

SEQ ID NO: 19583 - DNA, 307 bp, Homo sapiens
cccaggagtttctaaccactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacg

SEQ ID NO: 19584 - DNA, 208 bp, Homo sapiens
tctcccagggaactgatttcagcccgatgatacataatagctatgattgcagttttaaaggtggtggtaattctccttaattgagacacttttaggtaatttagtgctgcttgggactaggtgtgtgagaatgtgtatgctctggcgtctctgatttgttttgttttcttctgcagtatggagtgcaggattaattcacacaactgca

SEQ ID NO: 19585 - DNA, 373 bp, Homo sapiens
gaatatctataacctctttctctgtcttgggcctctgttcccctctttattttatcctgtaaatatgttcaaagattccattagaaaaacagacaaacagaaaaaagtacttctcagtaggacccaaagtaataataaacatataggattagctgaacaaatacataccaaatggttaaaagaggttatctcgggaaaagaatataaaaaaagacttcagcattatgcatctgtctttgtaagtatgtttaaggtgtgcctgaattacctgtgtagttagataatttttttttaaggtaaataaaggaaaaaagagaacagttactgtggagaaggagggtcagaatctgggttacagaatattgggaatggg

SEQ ID NO: 19586 - DNA, 897 bp, Homo sapiens
ctctcctaagagaatgaccctagatacagaaatagccataaacatgaaaatgtccatctcaggattgtttaacattgcaaccttggcccaaatggatgtgaacaggggaacagttaaccaaacggtggcaacacttgggacagaaatgatggaattaggccaggcatggtagctcatgcctgtaatccccacactttgggaggctgaagcaggccaatcacttgaggccaggagttcgagaccagtctggccaacatggcgaaactgtctctacttaaaaatataaaaggtagctgggtgtggtggtgcaggcctgtaatcccagctactgaggaggctgaggcatgagaactgcttgaacctgggaggtggaggttgcagggagtcaagatcgtgccccttactccagcctgggtgatggagcaagaccctgtctcaaaataataataataataataataataataataatagtaataaagaaatgatatttctggggagatgatggtgaaatatgaatcttcttttcttaatttttcatatgattaaattacatttataattttaaacaactgagatagtacaatatgtcatcaaatgtataaatgcattttccatcatgtctaaaaagtagagagaaaagatacaaaaaaaaagagtccttatgctaggagaggaaaaacttgtatattctgcttaaagaaaatctaaccacagctgaaaagacatgaaagcatctcagtcctcattccatgtgtccaccatgatatttatactgatattttcccttcagcaaaattattataattaccattcaaaggcatttatatgtgcttataactcttgaagggagacatcagtcatcggatgaatagtcttttagtcatcttctaaccc

SEQ ID NO: 19587 - DNA, 401 bp, Homo sapiens
ggagaaacctttagattatcagtcatactatgtaaatcttatttagctcctgatttagactaacaaactttttttttaatatgagaaaatagaaaatttgagaactggatatttgatgatatttttaaacacttacattttagatttgatcattgcaatttttaacctttttttcattagagatactgattatggctgaaataagtttgatatatgcttgagaattatatagggagagtaaagggtagagatgaaataagaatgttcatgtgtgtgaataactgaggccaggtattgattacatgggcattctctatactattctgcccacttttatatgtttgaagttctctgtagtaaaaaaaacaacaaaaaaaaaaaaaaaatttaagctacagatc

SEQ ID NO: 19588 - DNA, 357 bp, Homo sapiens
  misc_feature (36)..(36): n is a, c, g, or t
  misc_feature (39)..(39): n is a, c, g, or t
gcggccgcctactactactaaattcgcggattgtcnacnagaaaatagaaaatttgagaactggatatttgatgatatttttaaacacttacattttagatttgatcattgcaatttttaacctttttttcattagagatactgattatggctgaaataagtttgatatatgcttgagaattatatagggagagtaaagggtagagatgaaataagaatgttcatgtgtgtgaataactgaggccaggtattgattacatgggcattctctatactattctgcccacttttatatgtttgaagttctctgtagtaaaaaaaacaacaaaaaaaaaaaaaaaatttaagctacagatc

SEQ ID NO: 19589 - DNA, 677 bp, Homo sapiens
ctcaaagaagtactacatctggaggcaaaaagataataatcactatcatgaaaacacacaaaagtgtaaaacttatgggtggggcagatacataaaggagaaaaagaaaggaatcaaaggttatcactacagaaatccaccaaagtgcaatgacaaacaatgacagaggaagaaaacaacaaaggatatacacaacactcagaaaacagttaacaaaatcacaagaatatgtcctcacttatcaataactctgagtgaaaacagactaaattccccacttaaaagatagaaactgtctgaattgatattttttaaatgactcaaaaatatgctgcttacaagaaactcacttcacctataaagatatataccaattgaaaatgaagagatgatggccaggcccaatggctcacacctgtaatcccagcaccttgggaggccaagggggacagatcacttgaggtcaggagttttgagaccagctgggccaacatggtgaaacccatctctactgaatatacaaaaattagctgggcatggtggcatgtgcctgttgtcccagctgctcaggaggctaaggcaggataatcacttgaacccaggaggtggaggttgcagtgagccaagaatgcaccgctgccctccaccctgggcaacaaagtgaaactccatctcaa

SEQ ID NO: 19590 - DNA, 350 bp, Homo sapiens
gggcaaaatgaaaacgggaagccctttgttcaaaaattattataaagttgaagacagcaacagcatgggcttgtgtcactgcacacgttccatgcctccgatggctatgacggctagccttctcctgaggccagcaaaaaggtgcccaagcagaactgattaaggggacgcaggaatttatagagcctcaggtgtctgggtgagacagaagtgcgcccctcacctccaatccctggaaagaatccgaggatagttgggtcttccctggcatgtgagacaagattcaagcccatttcgtttgaatttccaaaaataagatgaccccagctgacgtgggtcatgagcacttg

SEQ ID NO: 19591 - DNA, 1156 bp, Homo sapiens
attctggcaaaaattgtacaaattttgtgggaagtcttgattgttacacaagagtactttctggttaagaacacttaaggtaacaatcactttcttcaagtattgttcaggtctgtagtattttaatgaatgccttgtaaattcagattcatccatgtatcaacacacttcttgactaaacttggaaaggagagttgtggtaaggtcagtgtttgctgttatgtaatctgtttgtccaaaatatttaaaaatcagtatcgtaagattcttaattcagagtcaagaattatcagtgtgacagcaattttcatatgttgaaagttttttccccagtagttgtttcatgataatcaagctgtttcttaggtgtggacctcaaaaagtattatcagttgatttttatgactttgaaaaattctaatttaaatgcaattgatatattgagagctcataaacagaatgtgctttccctgttgatactgctgctaatttaattctaggtaactgaaggaaaaggaatggtgtgcattcttgttgttttttcatactctcacattcatcttttatctagtctcaagatgatcttaagagtaaagctgtaattataactgattagaaagaatttcctaactttagtatagagggaagcacatagggtgctttcttaatgttctagaaagcagaccctattttagcttcttagtcatggagtggggggaactgtttctttctttttaaaattattttacagttatcattgtattcaatttttaaaattcttacaacctctgtgaagaaggtaaagagtagatgaataaattttaatgtcaacctagaacttcactccataatttatttgtgttatagtaagttattttaagctagtatatacccctattcaaaagtcaagatttaaacattgttgctaaaaagtaaatggggcgtgagccaccatacccagccagtgaaatattttcatatgttcattagctaatagtgaaaagcaaaaaattaagacagtgtttttggtatctatcaaacagttcaatccagtattggaggagatatggggaaatgggcatattaatatactgccggtgggaatatgaaactatattcttttttagagggcatttttacttttttaaaaaaaata

SEQ ID NO: 19592 - DNA, 615 bp, Homo sapiens
tgctagagacagggtttcaccatgttggccaggctgacctcgaactcctgacctcaagtgttctgcccacctcgacctcccaaagtgctgggattacaggcgtgagccaccatacccagccagtgaaatattttcatatgttcattagctaatagtgaaaagcaaaaaattaagacagtgtttttggtatctatcaaacagttcaatccagtattggaggagatatggggaaatgggcatattaatatactgccggtgggaatatgaaactatattcttttttagagggcatttttacttttttaaaaaaaataaattttagactcacaatagagttgcaaaaatcatacaccatttccatgggtcctttacccaatttcccctaatgttaacatgttacacgattatagtacaattataaaaactaaaaatgttcctaatctgggttaatctaatgttttttcatgatttgattgagattatgcaatttgggcaagaataccacaaaaatgatgctgtgttcttctcagtgaatcaaactagggcttacatgatatagatgtaccttatactggtgatggtaactctgatcacctagttaagatggtatcagct

SEQ ID NO: 19593 - DNA, 491 bp, Homo sapiens
gtagagacggggtttcatcatattggccagtatggtctcgatctcctgatctcgtgatccgccagcctcggcctcccaaagtactgggtttacaggcatgagccactgcgcccggcctgttttgtttttaaagcaaaaaaccatttggcacctcagtgatttgaagaccctgggctgttaaatctgcttctgacaacctactgtatagtgtgttgtattttgtgaatgtaaaatgttttggtttctgattttgaataaacttgtagagtagaccatgtttgtctttatgttcctggcaaatctgtaaaaaggaaagataagcttgtcattggagctcctaatgtttcataaatctttgtgatttttggtgtctagaaaagagtgtacatttgcgaggtgagaattgtggggaattccttgctggtgctgacatttaatacataagagatgagtttggaaagataaaatttccttgttaacttaaaaaaaaa

SEQ ID NO: 19594 - DNA, 521 bp, Homo sapiens
tcttggggaattctttttaaaatggcaggggtcattctgttcattctctatgtgatggtcacttctcatagagtgatggggccttctcccttaagacagacacgtggatcaggaatagacaggactgacaagagcccctcttctttcccagatggaagacactgcctatttctacaaaatgggggatacctagccacccctgggctgttaaatctgcttctgacaacctactgtatagtgtgttgtattttgtgaatgtaaaatgttttggtttctgattttgaataaacttgtagagtagaccatgtttgtctttatgttcctggcaaatctgtaaaaaggaaagataagcttgtcattggagctcctaatgtttcataaatctttgtgatttttggtgtctagaaaagagtgtacatttgcgaggtgagaattgtggggaattccttgctggtgctgacatttaatacataagagatgagtttggaaagataaaatttccttgttaacttaaaaaaaaa

SEQ ID NO: 19595 - DNA, 480 bp, Homo sapiens
gtagagacggggtttcatcatattggccagtatggtctcgatctcctgatctcgtgatccgccagcctcggcctcccaaagtactgggtttacaggcatgagccactgcgcccggcctgttttgtttttaaagcaaaaaaccatttggcacctcagtgatttgaagaccctgggctgttaaatctgcttctgacaacctactgtatagtgtgttgtattttgtgaatgtaaaatgttttggtttctgattttgaataaacttgtagagtagaccatgtttgtctttatgttcctggcaaatctgtaaaaaggaaagataagcttgtcattggagctcctaatgtttcataaatctttgtgatttttgggtgactgttatggtagagcactgtgatctgggcaacttttgtgctggtacaaatcctgtttaacacaaaaaacagtaactcattgaattaacttgccctggcgaggttagga

SEQ ID NO: 19596 - DNA, 1619 bp, Homo sapiens
ggaaacatcaatattttataaatgtttcttaaatataagtattttgtctgaattcatcttcactctctaatctgctggctctattgaacaccaacagagttaatgcttttagtagctttgtaccttttaaagctctattatgaatctttctaatacatatgaaattaatattatattagaattatgtacattatacaaaataattcataaccaagcaatattcatactatagaataatttattattatatatatgaatattacattgagactgaacaaataaccactctgctccaaatattactctcaagttctctgcctttaattattatagtcaattcataaaattctacatacagttgtacatggtgggttatcaaagtactccataatccaaatgcatctaaaagtattccaaatgcgcctttcattctagaatactaaaggaaagcgtttgaaagaagaggaaagtaaagcagacttctaactatttaatttaaacattgccattcagattgaataatttttaaatgatgatgctccactctttgatctacagacaaggttacaaaagatttacaattagtccaaaatcagaggattttaaatcttaaaggagttaagtttgtctcaatgatccaagactacaaaatttcttgctacattggcaaggaaatatgtttaaagccgagaactaaaatagctttttaaaatttaaaaattcctctgtttcttctgaatgtaaaacaggcaaaatgatcctgacttcaaaatgaaatatattgattgctctcaaaagatgtttgacaaagttaagtcagtatcttcaatgctttaacagtaggtagaggtctttggggttggaactcaggatacagtgactaggacagagtgcattcttaggctaattagtgcctagtcctctggagtattttttaatgccctgaatttcaagttgtcaaactggtttacatattgaatgacattttgaatcaataaaaatgagaaaaaaacatttaaatttggttttcatgtctcatttgagaataaagatttccttcatcaccctaagtaataaaagctgatatgtcttgaaacaactatagacaatcagaatgtgttcatttataaagtatcactggtttgtatattttaatgctgacctttgcctgtgaactagaaaatcaagatttgtagagtcaggttgatttgccttcatttaattcctgcaaatgcattggaagtggatggataacttggaactttttccatactgttttccccctcaccaagcattaaatctaattcaaaatatgtctttctaaaaaacaatagtttatttttaaaactaacaactaattgtgttattccttgttgataagaaagtcactttttagaaacaagaatatagctattgtggctttggtcgcttaggattctcatatatttacacatggcattattcttttcatatacacctaccagatttcaagctattggatatttcccttgtacaacctttacatcctttttttttccttaaatgctctgtacaatcacatgtaaagtcatgagctacaaacctcaataaaaatatcagtaaacaagaagtgatgtagt

SEQ ID NO: 19597 - DNA, 80 bp, Homo sapiens
atgcaactgcagctctgtaagcaaatctgagacgtgttcacatgtggcagctgtgcatgggtgagggggccttcaggaag

SEQ ID NO: 19598 - DNA, 334 bp, Homo sapiens
ttgtgggggtctcactgcattctacagatgtttcttttgtgctttcaaagtaacataattgcctcatcaaaagtttgtgaaacaggctgggcgcagtggctcactcctgtaatcccagcactttgggaggccgaggtgggcggattacctgaggtccggagtttgagaccagcctggccaacatggtgaaacctcgtctctactaaaaatacaaaaattagccaggcatggtggcggacgcctgtaatctcagctaccctggaagctaaggcagggagaattgcttgaacctgggaggcagaagtttcagtgagctgagatcgtgccactgtac

SEQ ID NO: 19599 - DNA, 593 bp, Homo sapiens
tgttgttgtttttaaagacaggttctcactgggttttttaaagacaggttctcactgggttgcccaggctggagtgcagtggcatgatcatagctcattgcagcctggagctcccaggctcaagcgatcctcctgcctcagtttccagagcagctaggactacaggtgtgcaccaccacacctagctaatttttttattttttgtagagacggggtctcagtatgttgaccaagcttgtctcaaactcctgggctaaagcaatcctcccaccttggcctctcaaagcgctgggattacaggcatgagccatcatgcctggcctagtatttctttatataatatgcataaaatgtctccaaaggcatacataagaaacttaacggtcggtgtttgtcgggaagggaaccaggtggactaggggatggggtgtgacaaacactggtcacttttacacccttgctggtcttttgtatgttaagccatagtaatattacatatttacaaaatacatacttttttaattaaaaaagaaagtctcctctgcaaacctgtctctgccctccccaggcctccatcctgggtccttcccgcc

SEQ ID NO: 19600 - DNA, 404 bp, Homo sapiens
atcgcactcaccttctcagccctgggtctctacaccaggacaatgcaggaagttgttagagactgtgtcttaacatatctgtactgaacagcctccttccctactatcataaaataaaagatgtcagcttgggaagagaggagaaatctctactcgaggtagggcggctggcatttgcagtcctgactttggtccccagcattcccctcctgctggagatgtcttggtgatgattactcctgtcacaagctagttggggaagacaggacccctccagcaaccctgtctgatgattcctaacgggtggtcctggatcagcagcatcaggatctggttcctcagccccacccagacccatgggatcataatccctgcatgtgggcccagcactctgcattctagca

SEQ ID NO: 19601 - DNA, 406 bp, Homo sapiens
tgctaggattataggcataagccaccacgcccggcctcttttttttctttttcttttctttatctggagactgagttttgcacttgttgcccaggctggagtgcaatggtgcgatctcagctcactgcaatctccacctcagcaggagagcaggaatcttcagtgatccacgggcagatctgccaccattgtgggcacctgttcctcccgcgacctttgtgcccgcctctctccttccagtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaaca

SEQ ID NO: 19602 - DNA, 380 bp, Homo sapiens
tctcctgcacatatcctgagttctagattcttccattatgatttctttattaatctgattttacttcccttggttttgcagctgtctgttaaactctttaacttgtcattgtactctatgtctttataagtttattcataatataattttatagtgttatttcaaggacacttttggaaggaaaagagagataaacatatgtaccagatctatcattctgaagtagaagctatcaaactttatgtgacgagaaaatgcatttgggtatatactgataggtttcctatcacttcatgctttattgcatttcttctcccatgtttttgaagctttctaatcaactgtggaatgatggaaataaaagaatccaagaagcaatt

SEQ ID NO: 19603 - DNA, 399 bp, Homo sapiens
gtgctgccttgactgggttcagagttctggagccccggcctctgctctggggcgctccacaggcctcttctggtctgcgggctcctcctttacttcagggcccttttgccgagggcttccttgttttcaaccctccttcctacccttccctcctccctcgctccctttcttgtcagtattctttccggtttttgaggcctatctccagatcgcttttccactcattttttaaaatgcgagcactttaattctgcctagaacctgggcaacagagtgagactccatctaaaaaaagaaagaaaagaaaagaaaagaaaagccacagactagaggaaaatatttacagagacaatctgataatggaccaaactatacgaagaactcttaaaactcaacagt

SEQ ID NO: 19604 - DNA, 427 bp, Homo sapiens
caggtagctggcgagtgtgtacgacctgacatcgccacttacttactgcgggaggcgccacggcacgctgtttgcgctctggggaagctgagaggcctggaatccgcgcgcctccccagccatctgtgctctcgcagcgcgctaggcgctcccggctgctgacttacaggatctgggttcctccgcctacgctctggggcgccctgaagcgcgggtagacacctgaggtttttgccttagccagtggcgcaagatgccgcggaactcttgggattggagagaccaagaaggctttaaaggggcgacacgcaggggcggcaaagaggaaaggttccccagggcgcgcgtgcccaaggctccagctggctcccccagtaaaacctgaaagagcaattttatccttacgatgtagaatttttcctcctaa

SEQ ID NO: 19605 - DNA, 346 bp, Homo sapiens
attctggcctgtacagcagactgtctcaaaaaatacataaataaaataaagtcaaggctggatttcagaccttgacacagaagtggtctgcctggaatagggggttggaggggacctggctagcaggattggctcacgggcccagaactgtctctccctttggaattctctgctctcattgcctacttgggctcgaccttatcagagaagcctgccccccttcgtagcatgttgctcaggctggcctctgactcctgggctcaaatgatcctcctgcctcagcacctccaagtagctgagagtattaaacatgtgccagggtgcccagctatgttacttctgggaa

SEQ ID NO: 19606 - DNA, 578 bp, Homo sapiens
accaccctgttttttctcagtgacactaccatgccattccagaaactgcaacaacgtgggggcagcaaccacattttatcttctttttatacatcttaatcatactaagaagttaaagagtggaattgaaggccacaaaataaaaatgaagtattagaaacagtctgaagctgagaaaattctcacctaaaacgtctgatgatggtgatagaaaacaaatattatctgtagtaatgacaagaagtgatagagcactagacagaaggcaagaaaagtggattcttgccttagatatgctaacgctgaattgcaaagtcgtttccacttaacacttgcctcatctaactatccctcataaaatgagggaataatgacatgtgatctatacattcgcatgcctaaaaggccatgattctggaagtaagctggactactacatcacagacaaatggacaaataacagaaccatcacatttttctactttggtagccatgactgccaagaaagcctattgactacaaacccctttaacaatgaaagtaaacaaataaaaattttctgagttatgttaaataaa

SEQ ID NO: 19607 - DNA, 348 bp, Homo sapiens
gcatagtgccaatttcacaatactgtattgtatacttaaacatttgctaagactgcagattttatgttttctctctgtctctttctcgtgcacacacacacacacacacacgcacgcgcacacccaaaataataataataataataaaaagaatggacaggaactttgggaggagatggatgtgtttatggaatagattgtggtgatggtttcatgggtgtatactcatctccaagcttatcaagttgtatacatgaaatatgtacagctttctgtatgtcaaccagacctcaaaaagtagttttaaaaaaagaaaataataaatatacagcattgcatttagaaaga

SEQ ID NO: 19608 - DNA, 458 bp, Homo sapiens
atgcctggcatgtactagatagatgatcacaaaatacggattttcttttctttttcaatgcaatcatcagtttattaatgaattagtgacacagagattggggaaagttggtgaaagcagaggctggaggaggatgtggaagaagggtaacagaaatagaaatgagagtccgacaagagaaaaggactctgttactgggatctggggccacccttcaccttctggtcttttgtagaagggtcctctgccagtgccaagtaggagggaggtagaagattgagctttcacagtgttccacattgccctaatcatttcatttctaatgtactttctgagttggcgcattacccagagctgattcatccctgaggcataggtctccctttagcctaacggagatgactgcatacaagtggtggctggataacctcaatcatcaaaagaaatatgcttcagaa

SEQ ID NO: 19609 - DNA, 176 bp, Homo sapiens
tctcctccaaactcatgaacagcccagaactggatttagttgaatctgtaattccagtagaaagtttggcctttccccaggggagaccaatctgggttggggtcattgttctttgtgatactggatttactttcttttgccatggtatgaaaagtattaatatggagaatacattt

SEQ ID NO: 19610 - DNA, 311 bp, Homo sapiens
gctataatttaagatcagatgagagtttaatattattattacaatgatgcacctgacaaggaagtatggttatttctgctgcatacaacctcttaagataatcactggaattatgactgatagtgttacaccaggactattagatttctaagaatttcttacaatttctgaaacacatattaataacacatccaaacaaatataacttaaagatttagcattactcattaattaacaatgtttcccatataatttaataaatcaaataagcccaattagtttaatatctctctttttataaggaaatatat

SEQ ID NO: 19611 - DNA, 424 bp, Homo sapiens
agcagtacaatcacaggaattaagaatacccttagatgttctgcaatgttctctttcttttcctgcagagcaatgaagtaatgagagatacagtggttgggatgtgagattttatgctcaactataaagatgctatcttttactagatttgatgaagcaagctgccatgatgaagagcctcatatttcaagagactgaaggtggcctctgttcaacagcacacaaggaagtgaatcttatcgacaaccactaaatgatcttagaaggagatcctgccccaatttaaccttgagatgactgtgaacctgcactaaaaacctaattgcagccttgtgaaaggtgctgagctaaaggatccaactaacttatacctaactcacataaactgtgagataataaatgcatgctctcttaagatgctaaa

SEQ ID NO: 19612 - DNA, 484 bp, Homo sapiens
tttcagaatttttttttgccctaatttgtcagctctagcggaaccaaccagtcctcctcgttcgctctcaaaggagactgttgactcatttcccggctgcagggtcacgccttaagacccttgagggtttcctccaggccagggagactctgcccgaatctccaggctcccctcccggtctctcccctcccagaaacgccccatccccttttgtttttaaagaacctcggctcctccccctttttcggctcttaaagggccaatccaccttagactagcctggatccagcgctggaaggatgcttagagaccagccagctagccagtgtcgttgcagacaaagaagctcaggcccagagtgcggacatgacctatcaaaggtcacagagcaagttaccagtgaagccaggacttgaacccaggcctatgactccgaagccagtggattctatggatctacttaaataaaaactaaaacaaaaaa

SEQ ID NO: 19613 - DNA, 369 bp, Homo sapiens
ccgctccgcagcgcagcgcatggagcccggcggggaccaccggagccggagcagcggcggcaggggcggccccgggccagcagtggcctcggcacggggccgacggctgccgcccgccggatcgagcggcagcgcggagccagaggaagacgaaggcgactagcctggatccagcgctggaaggatgcttagagaccagccagctagccagtgtcgttgcagacaaagaagctcaggcccagagtgcggacatgacctatcaaaggtcacagagcaagttaccagtgaagccaggacttgaacccaggcctatgactccgaagccagtggattctatggatctacttaaataaaaactaaaacaaaaaa

SEQ ID NO: 19614 - DNA, 564 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggtaagtgtgatgcttttcaagaactagaccactggcctgaattatttgtttttaatttacctttcattttatgttagcctgagtttagaaatgttataatgtctcttttattcattctgtttatttatcttccaatctcatggagagtagagttagtatactgtgtggattaaaacattcttcccataaatggataacacgttcgcga

SEQ ID NO: 19615 - DNA, 2807 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgacagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttaatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtgtttttgt

SEQ ID NO: 19616 - DNA, 2552 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgacagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcata

SEQ ID NO: 19617 - DNA, 2597 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgacagagaaatctggtctaatgaactttctcctgtcctcaatctctggaagaaactaaaccagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttaatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtgtttttgt

SEQ ID NO: 19618 - DNA, 1555 bp, Homo sapiens
accgttgctggtgggcgggggatgggcgtatagtgggctcctttgaaggttatttcacagttgaggattttgggcagatccataacagctggttccaaatttgacagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttaatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtgtttttgt

SEQ ID NO: 19619 - DNA, 2754 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgacagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttaatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtgtttttgt

SEQ ID NO: 19620 - DNA, 790 bp, Homo sapiens
ttcctatatttttattcaataggaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcata

SEQ ID NO: 19621 - DNA, 576 bp, Homo sapiens
ggcagcagtgagatgtgattgcaccactgcactccagcctgggtgacagggcaagatgctatttctattttttttttaaacgtaaaaatagtgatttgaaaattttagggaggatttctggtttctgggcctctgtttgctgtcaacagaaatgcctcatctacgtaccatgattttcacctgccatttagccttttattagatccagaagatgtttctaaccctgtttacttttgatgataggcttgaggaagtaaatggatttcagtaatatttttgatatatacttgctatatacctattgtgacagtttaaagcacagtaaataatatggaacaatgataagtgttcccatatttagtaaacatttgtttaattagttaacattaattattgtttagttaaagtagttgcagcaactttattctttaaaaatattctgcattttattttaagattcttgtagtacaggcgctaagaccggacagattgcaaagtgccatggctctttttgcatgtaaaactctgggtaagtgtgatgcttttcaagaactagaccactggcctgaattattt

SEQ ID NO: 19622 - DNA, 364 bp, Homo sapiens
ggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaaggtaagcgagtactaactgtatgtatttttatttcattgttataagtgactcctccatcacacatatatttgtcaggaatcatatagttaatagcagaagacccgagtcacactggcttaagccatataaaaattaattgactgatgtaactgaagaatccaatggtatctagcattatgccagcttgatgtaggaacttaaa

SEQ ID NO: 19623 - DNA, 456 bp, Homo sapiens
gcatcctcttgcccacggaggcctcactgcttagctcccagcctcaaggtcagatattcacggagccatgttttcctagtaagaggggcactgcactgagagctgatgcagtttgtgagcccatttctccactagggcctggacgggtaaatcaggctgatgctggtctgccccagacccacagagagagaactggaaataggaagttatgcttgcctggcctaggtgccggttctaactcagcttgaccagaaaggccctgtgttgggagtagcaagcactgtatcagccatcaatcaagtgggtcctggtttcctgggaggccatggtccttgtgtgcctaatccctgtcaagaaccccagagaggaggaaggaagcacccaaagctgatcacctccaacacttaccagggtatggcagtggggtccgggctgagacctgtgtacttggtactc

SEQ ID NO: 19624 - DNA, 473 bp, Homo sapiens
ctagcagtaatatggatccacaccacgccctcactctgtggccctggctaatccagcctgctgcctgcttgtgtaaataaagttctgttggatcctggctgctaccctttggtcatatattgtctgtagccacttttatgttacagtgacagagctgagtagctcagaagcctgacctggcccacaaaactgaaaatacttgtcattgagccccttatagagaaagcctgacacctgctcagggtgctgagaactttgactcctatctttgagatttttaaagttctaagggaaaagtaagtaacttctctattgctgtaattcttcacccacttaggcctcagctcactgggacatttttacccaggatgggaacttttgatgaaggaacaagtcaacagactttccctttgaagggctccttagcttgacttccaaaatagatgcaatgaatgaagaagcaattcacagat

SEQ ID NO: 19625 - DNA, 337 bp, Homo sapiens
taaggtagcgttttccggaggagatgggtgaccgggacccgcgcggggccagtctcggcagcgggacagggtggatcgctggcacccgattctggaaagggtggggtgcaggtcccaacggcccttcgcggccagcgccgcactaaggcgaatcccaagtcagatgcttccagaaagaccccagaaagaaaagcggcccctccctcgccaacatttccggggcaagaggacggtctcgccccgcgtcccggggccctgcactgacctgtgtaacaggacacgctgcactgagtccaggtcctccaggctgcggggggcaggtttggggatgctggac

SEQ ID NO: 19626 - DNA, 314 bp, Homo sapiens
tcctcagggcttctgcaccggctgttcctcctgcctgaaacactcctgggctccattctccaactgaacgacttctgctcctcctcctggtctcattttaaatgtcacttccacaaagcagaagccgtctcatatcgtgcactataaatgaggacttccctttgtattctcacagatcctgctctgtaccttcatggtgctgaacccaacttgtaatcttagttagatttgtgtcattattgatctcatacctccccaccattaacctgtcaggctggtgctgtgtcttatcttatgcacccttgaacctcaac

SEQ ID NO: 19627 - DNA, 288 bp, Homo sapiens
aatggccagaagtgaacctaacaatgaaacctgactctgtagtgaagcctgatgcaggctgcttagacacacgttgcttaattttaatgactcacaatgattctccattatatcccaggaaatgtactgtaaaaatgttttgtaaaagaatgagagccttggtaatgggaacctgcactgttctgcaattaaatcattgccagaaagtgggggctgtagtgtgcttgtttgtttgagagtggtgcaaaggcagtggagtgaatggaagggaagacaagggaagagaaa

SEQ ID NO: 19628 - DNA, 444 bp, Homo sapiens
cagagagcctatgaatggacatgcagtcagggaggtttcacataaccaagattcctatcccagaaaagcagatgtccatagctctgggaatggaatgcgacccttgtggacagcttacaaatgaccttaaatccctcactaacctaccaacactctcactaaacttaataataaatgctggtatatccagtgcattggtagcatcgcaggaccagaaggcagtgacccctctggacccagttttcactatcttgtgtgtgtcttttatttctcaacctgccgatctgcctgggaacaaagaaagagccctgttgcattgcaagctgctggccagatcccgcaatatagtcccagctacttgggatgctgaagcatctgtagagggagagctgccccaaatcataaatcaaaaataaaagccaattacatcaataactaaaaaaa

SEQ ID NO: 19629 - DNA, 575 bp, Homo sapiens
aacctatggtttgaacatctgagtggctccaggcttggaaattatattcacctgtcaccatccatcaatccatccatccatctcacaaatattcacttgttccaggccctgtcctaggccctggggatgtggctggtgaacaagacagaccaaactgtaccctcatggagctgtctgtctggcagggctatggacgtcagacaaaagattacacatgcatggctaatgcccttttaaaatcaaaggccctgcatcaggcactgcaacaccaggcttagaatacccctgtcctctggcttgctctgtgacctaagtgagtcctttctcctccctggccctgtaaggggtggcccagataggttttgtgtttaagggaaataccttctgaataaagggaggaaagaccattctatccattgtggaagcgcgtgccaccacacggggtgctgttcctgcgggactcctttaaggatgcagtcatcctcttggtggtttttcaagatgtcctagccctggctctgaaaggaggtgtcccgatttggggacaggagttccagagttactctgagcagagc

SEQ ID NO: 19630 - DNA, 365 bp, Homo sapiens
gtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatct

SEQ ID NO: 19631 - DNA, 1759 bp, Homo sapiens
taacccctcctctccccctcagcactagccaaatccacaattattagtaggattagtattttgccattcaaacactctccaggcttaataaccaagcactacttctcaacttatgtttcacctttaaggaagattccacttcctcgcggtctaggctgccaccaaagttgccacttttctgagaaaaaaaagacatccatactccatcccaactccacctccctcctccctccctccccaccccaaagaccgagattctggggatgtcaaggctaaaagtcccgtttgtctctgatacttctcctcagttcttgcctctgctttgtttgctctgcaagtgtttcacaactacgagaggaccaaaataaagggggtggggagcagcttttcgctttcctctagattttgggtcggtcttgtgtttttcgggggtgtgtttaaggcttctccgtgcactgtttgcagaggctggaggagacgctgttaaacagggcgcacttctccgggcaggaggcagccgggggcagtccggcgctgaacgggtagccggctgcctgctcgtaggcgccgagcgccgggtgcagggcagcagctgctgccgctgcagccgccgagctgggcagggaggcagccgagatggcctggccctggttgaggtaggcgactaggcgccgcatctcctccagggcctgcgcctgcatgaggatgtagttcttggcgagcagcagcgtggcgatcttggagagctttcgcaccgaggggctgtgcgcgtaggggatcaccgcgcgcagctcgtccagcgcgtcgttcaggtcgtgcatccgccggcgctctcgggcattgatgttaagccgcagcgccttttgctctttggatttcttgctgctgctgctgctgctgctgctgctgccgccgctgccgctaccgctaccgccaccgccgccactgctaccgctgctgctacccccgccgccgccgccgcccaggccccccggggggacgctggcgccgccgtggaggtgggcattggagcagccctcggctgccttcgcgccaccacctcccgctcccggggaggcccgcgggtcggctactccggcccgcagcacgagctcgcagcgaccgtcgctgtcgtcgtcggggctctgctcgccgccgctgctctcggccaccgagccccggctcgcgctttcgccgtacttgaggcaaagggcggccccggccggcaggctgcttaggctagggtcgcccccaacgccggctgaacctactagcagcccggggacacccaccccgccgccgccgccgccgccacttcccgcgctgccgccgccgcctcctccaggcggcggcaacagcagccctgccccctcggggtcagccggctcgaagcagcccaggggcgacgaggaggaggacgccgggcgttcccgaggcggcggcgccagggacaggtccatgcccgggggcgtggagcggaaagccgcttccaagcgcttggaggtggaggcgctcaggctcttgtgcaggaagaggtcgtcctcgccggcggccgctgcaccgaggtgcatcccgcgctccatggtcccgcgccggcgcgcagcccgggccgccgcgcccgctgccgccgccgccgcctcggccccggagtcaggcggccccacagacgcgcgcgagctgggctccggagctggtgcgcgcgtcggtcctggtgctgccgggagccctctccccttctttctttttctttttcgccttc

SEQ ID NO: 19632 - DNA, 610 bp, Homo sapiens
atggcttcaataacagaactttattttctcacagtcctagaggctggaagatcgtctgggacaagtccaggtgctggcagggttgatttctcctgaggcctctctctgtggcttgcaaggtggctgtgtcttgacatggcctcttctctgtgtgtccctcccccttcttataaggatgtcagtcagattggattagggcccaccctaacggcagcattttaacattcacttatttaaagaccttatctctaagaacattacattctgaggacctgagactttcagtgtataaatttgggaggacacaatttagcctataatagtgctataaagagaagttcaaaaatgaagatggagattttattttttaagcaaaaaaataagtttgcttttagagtgttaaattgggaatgtacactagatagttgatgttgtcactttggatttggaagagaacacaaggttggttgcttgatttggaaagcatttgcttagaggtagtatattaaaattagagcaacataaggaaattgatttttctccacatttctgggacaagaggaaaaagtagtataagtaatcgtaaaaaattcttagaaagtatgaagaa

SEQ ID NO: 19633 - DNA, 543 bp, Homo sapiens
gtgtttgggtatgatatatttgcctgtgatttctcattctcagagcattcccataaataatgccacaaagtagagtttgatttttttttttttgagacggagtttcgctcttgttgcccaagctggagtgcaatggcgcgatctcagctcactgcaacctccgcctcccaggttcaagcgattcttctgcctcagcctcccaagtagctgggattacaggcatgcgtcaccacacccggctgtttttttttttcgcatttttaatagaaacggggtttcaccgtgttagccaggctggtctcgaactcctgaccttaggtgaactgcccgcctcagcctcccaaagtgctgggattacaggtgtgagccaccgcgccctgcctagagtttgattctcttaaaccgttctactaaaatactatcagtttaaactaccatctacagaaataaaaaacataaaccactaaaagattaaagcatttaggagtttatatgcaaagaagtcttgcaagggagtacaagctttaggaggacaggcttatc

SEQ ID NO: 19634 - DNA, 327 bp, Homo sapiens
aaaatagtaaaagattcattggaagagtgaaatctcttttaggttgtaggagatgtctcttcactcatctgatatgatacagttttaaagtgataattgagacttttttatggagtgcagttaagaaatgtcattactgtttattacagaaaatgaaataaattggtagtgcgggtaagagaactcatattgtagagaattacaactctttgggaaatacgaggtgagcatcttctttgggcacgagaattttttttcaaataccttccaattagcacaagccttgtgctcagtatttcctccactccccattcaatgacggtttat

SEQ ID NO: 19635 - DNA, 2056 bp, Homo sapiens
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctc

SEQ ID NO: 19636 - DNA, 547 bp, Homo sapiens
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatgtcagctgccccaaaagtgaagttcgagcaaaattcaaattttcccttctgaatgctaaaagggaagaaacaaaagcaatggcctcgtgccgcctcgtgccg

SEQ ID NO: 19637 - DNA, 349 bp, Homo sapiens
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggtacatgctcttaaaaatccctcac

SEQ ID NO: 19638 - DNA, 5586 bp, Homo sapiens
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttctcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaattttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattgaattgactcctattttctcacactttggaaaagacacctgaacaataaatgaatcctggatagtctactctccttcaaacaattaactgatacttgcctttgggagatgcatacaaaaggagagaacccttagactatgtcaggtcacactaggaacctcccctcactccccgtttttcttcattgtgtttcagttactgtactaacattgtggatgatactgaaattctgcataatgtgaacaggataaactatttataaactgcttttcatgggccagttctttattataaatgaattttagctttaaatgcatatacacgttcagtgtttgatagttgtgttcttaagggaggtttgttctggtgcattgtcctggagaagcagaagcagtcagtgttggggtaccacatctgacttactgtggtggtgaccagtgtgcttcttaagggcaagatttatatttgaccacaagggaaaaagtgtgtcactggaaaaaaacgcatatacctatgtttgcaaacataactattcttcagattaaaatttgtataatttgtttatttaatgtttgaattcaggacaaaagaaaaaatgaagcttgaggtgttttcaaatagaccttatttttgctatctctttgttaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatattctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaaaaaaaaa

SEQ ID NO: 19639 - DNA, 4046 bp, Homo sapiens
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatattctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaaaaaaaaa

SEQ ID NO: 19640 - DNA, 4567 bp, Homo sapiens
gtatcatgtattcaggaacttagttggagtaaatgtttaatggttatgttttcattttggatagtatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttctcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaattttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattgaattgactcctattttctcacactttggaaaagacacctgaacaataaatgaatcctggatagtctactctccttcaaacaattaactgatacttgcctttgggagatgcatacaaaaggagagaacccttagactatgtcaggtcacactaggaacctcccctcactccccgtttttcttcattgtgtttcagttactgtactaacattgtggatgatactgaaattctgcataatgtgaacaggataaactatttataaactgcttttcatgggccagttctttattataaatgaattttagctttaaatgcatatacacgttcagtgtttgatagttgtgttcttaagggaggtttgttctggtgcattgtcctggagaagcagaagcagtcagtgttggggtaccacatctgacttactgtggtggtgaccagtgtgcttcttaagggcaagatttatatttgaccacaagggaaaaagtgtgtcactggaaaaaaacgcatatacctatgtttgcaaacataactattcttcagattaaaatttgtataatttgtttatttaatgtttgaattcaggacaaaagaaaaaatgaagcttgaggtgttttcaaatagaccttatttttgctatctctttgttaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatattctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaaaaaaaaa

SEQ ID NO: 19641 - DNA, 1717 bp, Homo sapiens
  misc_feature (1647)..(1647): n is a, c, g, or t
  misc_feature (1697)..(1697): n is a, c, g, or t
agatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaatacctccagantcccctgttccaaatacttatttttttatggcctgtctttgacaggttcngatgctaccctatgcttttg

SEQ ID NO: 19642 - DNA, 541 bp, Homo sapiens
gatttaggtaatctctgggaaaacacaagatttacagactgcagttttttcgtgagaggacaagaatttaaagctcataaatctgtgcttgcaggtactttctagttatggggtaatatagtacatttaaaaaaatgcatttatgcataaaataatgatacataatcttgttacagctcgatctccagtttttaacgccatgtttgaacatgaaatggaagaaagcaaaaaggtaaacatggcttaaaggctaatattgaatttatataaacgtaaagtagttgggtgtatgttttaaaagtaatagtacaatgttctcattgtcatactgtgataagcagggaaaatttttacaaacaggaaaaaaatgtgttctataatagaacaatagatgtagctcagtgtggatgtgcagtcaatattccagagaacagctattttttatgcccttctggtaggtaaattggatagttgttatccaaaaggatagttatccaaaggactattctggtccatagctatttgagaagtctctgttcaa

SEQ ID NO: 19643 - DNA, 1617 bp, Homo sapiens
  misc_feature (69)..(69): n is a, c, g, or t
gatctcagagggaaactgcccagagaggattgtgaccatcacagcccccacagacgccatcttcaaggnctttgccatgatcgcatacaagtttgaggaggatatcatcaactccatgagcaacagccctgccaccagcaagcccccagtgacgctgaggctggtggtgcctgccagccagtgcgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccaggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctc

SEQ ID NO: 19644 - DNA, 1563 bp, Homo sapiens
  misc_feature (69)..(69): n is a, c, g, or t
gatctcagagggaaactgcccagagaggattgtgaccatcacagcccccacagacgccatcttcaaggnctttgccatgatcgcatacaagtttgaggaggatatcatcaactccatgagcaacagccctgccaccagcaagcccccagtgacgctgaggctggtggtgcctgccagccagtgcgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccaggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctc

SEQ ID NO: 19645 - DNA, 252 bp, Homo sapiens
tgaccaagctccaccagttggccatgcagcaaaccccctttcctcccctcggacagaccaaccccgctttccccggtacgtacccagcccttttctcacctccttctcttctcacctggggactttctctttctgagctgtgttattcggtgcagtgcatagaacaggtgcagttggatttgtgagtgccggtgctgcggcgttcacatgcagcaggcttgctggggctggggccggggacagggtgggggc

SEQ ID NO: 19646 - DNA, 296 bp, Homo sapiens
agtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctacctt

SEQ ID NO: 19647 - DNA, 381 bp, Homo sapiens
catgagccacccgctcctggcctgggattttctttttaagatgaaaaagacttgagcacatccacaggtttgggaaaaagtcagcagagtgggagaagctgaaaattgaggaaagagaggggataattgatggcaggctcagggtatacacctgggaaaggaccaagaatttaaatggaaggattaactttggaacagtgcaggctgcaatacctctttctctgagactgaaaagaaagcgatacaatagatccagaaataaataatttagctagggagtataatagttgagggatttcttacttaatgatttctattatctctgtgaagtaaggtctttactgaaagtgaaggagatgaggattgaatgaaaaacttgaa

SEQ ID NO: 19648 - DNA, 2334 bp, Homo sapiens
tgcctcgccagccgctcgggcagctcccgggccgcggccagccgaggatcagagcgcttgccccgggggtctgtcgcgtcgcaggcgccgccggagccctggccatgaggaccctgtggatggcgctgtgcgcgctgtcgcggctgtggcccggggcccaggccggctgcgccgaggccgggcgctgctgtcccggccgggaccccgcctgcttcgcccgcggctggaggctggacagggtctacgggacgtgtttctgcgaccaagcctgtcgcttcaccggggactgctgcttcgactacgacagggcgtgcccagctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcaggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatagatggtgatataaatatttccaaatgcatttgtaaacattctaaatattctcaagtcatgttcaatgtttcctaaaccttcaattttggccaaagtccccaaacacatcattgccacactctgaagtagagaaagaaaatttaggggccagttctcaaggaacacaggtcctttatttttattttaactaagttgaagacccactcaaaaagctcttgtggttttatgttcttgacctttcaactggagtcctctcattcagcaggtggcccgtgagacacagaatacatgtctgtttgctaaagtaaaattactgtaactcagtccgattattggtgacggaagtgtcatttaaggggatctatgttttgaaccttgcagtctattttataatcttttaaaagtttctcactttaaaacatgtatacaggtatgcacactctacacatatatttccatatatttaatattccataaattctgaaataatttcaagcaaattatcacaaataatttttccacagggcaaattatttaaaattttagtaagcattctgtaatgaaaaaccaagttatactaaaaacattttttgaagaagaaattttttttttgcttaagaagtgaaaggatcaaatgctcattgtaggtcaatgggagttcttttaaatgttataattttcatgaaaagaaatgttgacaccagtgaatgaaacaattgctttcattctgaaaattctaccaccatttgcatctaagattatttccaaggcttaaagcctgaagctgaataaaataatctttcagagtccagcttcaagtttagttgatgtaagctcactatttttttcctaccgcatgcattttctaatgtttggggtggatggtgtgtcggttatggaaggcatagacgtcattacaggtgctacgatctcacacacacacaaggaaatgttagtctccttattttatgattggaaaatcaatgacctagaggcaaaatggcatgtttaaggacctgggatgacaagtcattctgcagtcagccacagagccaaatttggactcctcaaccagaactccatgaaaagcctgactttgccaaacactgtgctggaaaagctaagcccctttcatttgtgaagtaaattttaaattcaagatatttagtttagagaattgagtcttgagatgtaaactacatgagatttctttggtttcaattgaataatattcactaacaaatgatttactaaaatacgtatttcttggtccttatcatgtaatgacagattcacaacagcaataaggatggagatttccccaataattaataacaccgagagtagcaatattttttactgtattttcatttaattgtcaaagttgtttttgtggaaaattaaattcttcagaaattaataataaaatatgtgagt

SEQ ID NO: 19649 - DNA, 4071 bp, Homo sapiens
tgcctcgccagccgctcgggcagctcccgggccgcggccagccgaggatcagagcgcttgccccgggggtctgtcgcgtcgcaggcgccgccggagccctggccatgaggaccctgtggatggcgctgtgcgcgctgtcgcggctgtggcccggggcccaggccggctgcgccgaggccgggcgctgctgtcccggccgggaccccgcctgcttcgcccgcggctggaggctggacagggtctacgggacgtgtttctgcgaccaagcctgtcgcttcaccggggactgctgcttcgactacgacagggcgtgcccagctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcaggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatagatggtgatataaatatttccaaatgcatttgtaaacattctaaatattctcaagtcatgttcaatgtttcctaaaccttcaattttggccaaagtccccaaacacatcattgccacactctgaagtagagaaagaaaatttaggggccagttctcaaggaacacaggtcctttatttttattttaactaagttgaagacccactcaaaaagctcttgtggttttatgttcttgacctttcaactggagtcctctcattcagcaggtggcccgtgagacacagaatacatgtctgtttgctaaagtaaaattactgtaactcagtccgattattggtgacggaagtgtcatttaaggggatctatgttttgaaccttgcagtctattttataatcttttaaaagtttctcactttaaaacatgtatacaggtatgcacactctacacatatatttccatatatttaatattccataaattctgaaataatttcaagcaaattatcacaaataatttttccacagggcaaattatttaaaattttagtaagcattctgtaatgaaaaaccaagttatactaaaaacattttttgaagaagaaattttttttttgcttaagaagtgaaaggatcaaatgctcattgtaggtcaatgggagttcttttaaatgttataattttcatgaaaagaaatgttgacaccagtgaatgaaacaattgctttcattctgaaaattctaccaccatttgcatctaagattatttccaaggcttaaagcctgaagctgaataaaataatctttcagagtccagcttcaagtttagttgatgtaagctcactatttttttcctaccgcatgcattttctaatgtttggggtggatggtgtgtcggttatggaaggcatagacgtcattacaggtgctacgatctcacacacacacaaggaaatgttagtctccttattttatgattggaaaatcaatgacctagaggcaaaatggcatgtttaaggacctgggatgacaagtcattctgcagtcagccacagagccaaatttggactcctcaaccagaactccatgaaaagcctgactttgccaaacactgtgctggaaaagctaagcccctttcatttgtgaagtaaattttaaattcaagatatttagtttagagaattgagtcttgagatgtaaactacatgagatttctttggtttcaattgaataatattcactaacaaatgatttactaaaatacgtatttcttggtccttatcatgtaatgacagattcacaacagcaataaggatggagatttccccaataattaataacaccgagagtagcaatattttttactgtattttcatttaattgtcaaagttgtttttgtggaaaattaaattcttcagaaattaataataaaatatgtgagtctcatcaaggctagcaactttaagtcagtattaacattttcatactgtttctaacatttattaagctagatttttgaagctatgtctgggtaatttccaatgttacttaaaagtttttttttctttgagacagagtctcgctctgttgcccaggctggagtgcagtggccccatctcggctcactgcaagctccgcctcccgggttcacgccattcttctgcctcagcctcccaagtagctgggactacaggcgccgtcatcacgcctggctaattttttgttttttttttttagtagagacagggtttcactgtgttagccagggtggtctcgatctcctgacctcgtgatccacccacctcggcctcccaaggtgctgggattatgggcgtgagccactgcgcctggcctgttacttaaaatttttatactagtaaataaactttttgttcacatttataaaagctctatatttgtttgactagaaaataacccaaattttctggaccagtcagagaatgataaaatttcaccaaaaataaaacaaaaaaatccttcagaactgataggtataggtacaacaactactaatagcaataaagcaatggtgcttttatagttccgatatgtgttataacatttaacataattgaggtgtataaaataaatttttcaccttatgcatttaatttttggtggatgaccagtaattgctttcttattgaagttaaatttttgttatttctattcttgagaaaattttatgggctagaggagttaactgttaaataacagttttgaaaagcttgttattaattttagcaaagcccaagggaaatagttcagaactgaaacatgtagtccaagtgatgaatgaaaaaccaaaagtttttattttcaaatttaaaaatcaaagtatataagacctcttggcactcttttttaataagtaccttagtcttagggccctatccccaggcactctaaaaagatttacgaactctaaaatcccttaatagactgattttcaaaagtgctcatggaaaataattcgaacaaaaataaatacagccaccaggaaagaagggaaaagaagcaagggataatggccatttttgaagagaaaagtgaaaaacaagtgaaggaaaaaaagaatagaaaaaggaataaggtaactataatcacagtattctttttggagttttgctttggtttttattcgagaatgttacaattaagcataaaccgcaacagcaataatttaaagtgtttggttatcatctggcataaaaatttcagttagctatcttttctagatgtgcacaaaattgatgttaataaaactggttcctgccctctaagaatattctagtgaaggttcatacaaacaaccacaagttggcttagaaaacaaacacctgggccttctgaggtccaagcaatcagacaaagagcaccgtgagggaggtcacactctaggtcagggtgaaagacagacagacacacgtttaccctctctccttcctcatatcccactgaagagacacgattcacagaagagaataagtccacagcagatgaaccagaataaaggggccatatcctttaatacggggtacagaagaagctggaatcagagatgagagccattcttggtggggcagtcccaccaagcaccaaaggatgaataaaaagactctcagccctagagacaaatttgtgaaattgaaaatgaa

SEQ ID NO: 19650 - DNA, 578 bp, Homo sapiens
cgccacctgatcatgcttccaaccctgcctgtccccatatggtggcatgtcacccccgccttcactatactttcaaagcttcccactgtcttcagtatgcaatttcttcacgtggcttagaggggtgtcatgatcagaccccttctccagccccatggaccttctatcagccccaagggtgccatgcatccctggctttcttattttcattctcagtccaccttcgacccctggtgcagacacataacctaggcctggccaatcacagcatttcattcccagactgcagtgttggttcaaagatggacgtttgacccaatctaggtcaatgaaactcaactggagacttttacagaattctgcggggaggctaagcaagtaaggggtatagggctggaaggtgtggggccatctctagtcaccacctgcaaagctggcatgagagcaaagccaacctaggaaggtggagccgagatggagacacaaatccctaaaattacttgagtccttggatctagccatacctgaggcttacctcttacataatccaataatttacctttttgctcatgctatgg

SEQ ID NO: 19651 - DNA, 457 bp, Homo sapiens
acacgccccactcctgacagctctgtgcagcgagttcgtgcgcgagcgggtggctgtctgccaggcgaggggcgcgggtgcccaagagggcttcactgcttctggaaagatcacaaggaaaaaccacctccgcggcgggacgctacccgcgggccgctgcggtcccgctcgcggccggcagggggcaggatgtccccgcgagtcgcccgtgtcttcgggtgtcctcaggtcaccccgcaccgctcgcagcctccgcgcctagttaaagggcgacgcactcatttctgcaaagaaggagcccagcggcccctccccggggaactctttccatcaactcggggcctaataatttacatttaatttgttagcggtttaatgtttaattttaaaagcgagatgattcattaccatattaataaataataacatttattattctcctaatgagtgtccaaaa

SEQ ID NO: 19652 - DNA, 397 bp, Homo sapiens
gctgctgtcccagtgaggccccccgcaatcctttcgcatctgggcagttccaaactagaattcttgcctgccctgcctcccatggaatgcccttaccctactgccaatgtgatctttctgaaacagcatacctgatattgtcattcccaggagcagcttcccacctccctcaggatttaaactttaaactctacagctctccacactcacctcaacaatgagctcctctcatcatttcttctcctttgtcccagtcacaggccacttttggggccatgccaaaccactttagtttctgaagcttctgcccttggacctgcatgactgcagtcatcttaggccccagtcaagggagcaacaggtcaagggcagaagcttcagaaactaaaggggtacg

SEQ ID NO: 19653 - DNA, 514 bp, Homo sapiens
tcaaattgaacacagtttgaaagaattaagaaaagaagctataaaaaataaattgttcaaggattcttcctgtttctaaacaccacaagattatgatgatagagacatcatttgaagtggtagagagtactgtgaaatatctatatgtgaatgtaatgaaaatgaaaaaataatctgatgaatttttaaaattaatcttgttagagtcatttttgagaaattgtatgcaagtgtattgattgaaaatgaccttctcattcaagaaaaatttattgagcacttaccaagtgtcaacaggtgaatgtgaataaaatagatatggtccctgccttcttggagttgaataaaatagcaaacacttattgaatatttattatatgttgtgcattataatattaaccaatgtttattgagttgttattatatgccaactatgccaatcctgtcctaagcaatttatgtatgttaactaatttaatcctcacaataaatctatgaggtaggtactattatt

SEQ ID NO: 19654 - DNA, 477 bp, Homo sapiens
aagaattaactccaagaatcaaatctattccggacagataaatacatttttcttcttttctttttttggggcctggagtaaataatgagagaaggaagaaagacaaaaataatttgaggcccaaactctttgaaaagtgatggacttttcatgagttttcaggagaagtgggagtgacgggcatttgtcttgtttggagaaaagtgtgttcttccgggggtggtggctcatacctgtaatcccagcactttgggaggctgaggcgggcagagttcaagacccaccagggcaacatggtgaaaccccatctccactaaaaatacaaaaattagctgggcatggtggcgtgcacctgtaatcccaactactagagagctgaggcaggagaatcccttgaacctgggagacggaggttgcaatgagccgagatcgtaccactgcactctagacagggtgacagggtgatactctgtctca

SEQ ID NO: 19655 - DNA, 289 bp, Homo sapiens
cattatctctagtagcacttcttgtcttaaagtctagtttgcctcgtatcagtatggctttcttttgctgtatgcatgacttgtctttttctatccttttactttcactttttctttgtctttacatttaaagtgtgcttcttatactcagcatataattggattgcctttttttatccagcctggtaatattgggtttttaattaaaatatttagtccattttcatttaatataattactgatgtggttggaattagatctcttattttgttattcttcctatttgcc

SEQ ID NO: 19656 - DNA, 345 bp, Homo sapiens
agaatctggggacacagcagccctttctgtccagatctgtccacctcctgtggctggacagcaagggatacctgactcccacaatctccaggcgaccctgtcaccaaacagtctgcaaaggacagtccgcctctacccctggaactcgggaaagagaaggagaagcccaagcttcacttagcagaaccgggcctgtccctcagttcagagagcagagatgctccaagaggcaggggtggttacaaaataaggtaacaaacaacgatgaatagacacaaacgaagcacattttgcatcagaaagctccaaggtccagtcctcagccagtgtccttccagcctcaag

SEQ ID NO: 19657 - DNA, 383 bp, Homo sapiens
tcagatctggctggagcagattcagaaaacctcttatctcccccaggcggatgatgtgcccaccgaccacatcagccacgtgagatccagtgcgacagtggagcatgtgtgcgcagaggagacaggaacaacaaccgggatgtcatgcgggcgcactggggctccttgtggccccagtgcacagaattctggtggacccaccatgtgtgggagctcagtgagactcaaagtaagtgcaaggccctcctcacacatcgtacgctgaaggtggagcacactgggaaaatgtgcatgcatcaagaagaaaaatgaaaactgattttgtgcaacatttccactgttcttggaagaatgaaataaatgcatatgagctatgaaaaaag

SEQ ID NO: 19658 - DNA, 187 bp, Homo sapiens
tcacatccgtggggtcttaatccccatgggtcttgattcgcttctaagtgtgcccctcgcccagcctgagccactccctgggtaccgcctgggctcccagctcctgccatctggggagtccacctcctcactaaccccagagggcttgtgtgacccatagattgggcttcccggctctaacgccctc

SEQ ID NO: 19659 - DNA, 477 bp, Homo sapiens
tcggaggtagtgtagggagagatacctgggagaccagtgaggggaaccgtactattaacagtaatattttaactacttagcaatggatatctattaaacaaaactgatgtaacacttactacatactgtagatgggaaagaaatggtataactccacaaaagaaccaagaggagagagttcaaggatatggaaaaatgagaaatcttctctgggaccatttttcccccaactccgggaagtagcagctgatggtggccatcattataaagataaatgataacacctgccgaggaactccaccaagacactcgtagttcttggtaaacaagaactaattaattttcacaacacccttgtgaggcgggaaagtagcatcttcctgggtttactgacaggggaagcatcagcacataaacataagtggatgttggcccctttcacacagtgggagctcttgacagggctgggaataagaa

SEQ ID NO: 19660 - DNA, 431 bp, Homo sapiens
atagtcatttttattcccgaaacactttgtttccaaatatctttgtgttttggaaatccagattttcttatcttgggaacctgctgtattttatcttagttttatattctatgagcttctctcttggtgagctccaggttgagctgctctgctggcttaggcttcatctggtagaattaaaagttacattgggtcacacgtcccaggtgttgcatcacaggccacagaattacctatataaaactgagtgcaaatgtagacactcttccactaaattgtttttagcaattaaaagtgtacctttggttttgcagattttacctcccaccctgtgacccctcagtgtggtttatgacattagcatttccaagagtgtgttcattataaagaattgtttgcatcagaaagtagagagggaagctgaggtgcag

SEQ ID NO: 19661 - DNA, 307 bp, Homo sapiens
aaacaggctgtccaaaatgcaagatcagggaggagcagagccagagccaggtcttaaaggaaaagttatttggtggcgcagctgagaagtaaaaatgtgccttggctcggccagcccccacatcggggagatactggagtttaacaaacccaagcatttgttcatctgcttcctgcatggtaagatggttatggggctgttgctataagatggggacttccaggctgacctggagcaagactccgggctttccatctctcagctttggataagggttgtaaaacccaattgatggctgactgttgga

SEQ ID NO: 19662 - DNA, 183 bp, Homo sapiens
tgcccgcgtggctgctacctccgaggcttctgtgtcaccgggtagtggaaatgtcaccgagtatcagagcttcgagcctcctccagatccatccaaggtggcatcactaagtggcatttgtgtgctaggcacgtaccctcttttacatacattatcttcgatcagttcagcttcttctgcata

SEQ ID NO: 19663 - DNA, 711 bp, Homo sapiens
gaggtacttgctcagccatcgcaaagcgctaattgtgagccaccatacctaccacacctggattaccttcttaaaatgccatctctttttctcagagtgaacccatctcctctttgctaaaccatatctgctccccataattccatcaaggaatgttctcatggtactctacacactgtagtggagaaaggacttcccagagaatgcttctccactcactcatctgtccaaaacagtcagacacgcttcttgctagctgctctgagaaaaatagaaagtgtgtgcttcagggacagtactgactgggggctccaagtagtgtgggtgggatttgaactggtggggaggaaggctgaatgctaggagaaggagggaattggcgcaggcctaagtaaacacaagcaaaaggagaggacaggagaactgtagggactaggacccttgtgaagtcaaagtcagctcttgcatggtgggccttaatgcaggcccagatgcctggagatgcagctttttctggatacactgaaggctgcagaatgttcctggaaagagactcatatagaccaggcctggcacagtctatggccactgattttcaaatcaatgatgggcatctccctgccccacccggctcccagagagtctgatcagtaggtgtgaggcccagaaatctgcactctggcgtgggtgacaaagcaagaccctgtctca

SEQ ID NO: 19664 - DNA, 1311 bp, Homo sapiens
gttttctgtttatttaatattttcctttatgtcaactcactttctaaaaattttaagttaattttaaaatgaaagtttataccaccataaaaataaatacaatgaaaacaaaatggtgtattatgtaactagactcttgtcacttagggttcctgtgctaaaaattagaagttgttaaatttattaaacaagtactgttgcaaaatgggaactttttttcttgacttaattgtgattaataatttccttactgagtggtatttaaaatgtcttgttggcaaaatcatgtaacacctaaagtcatcttttgtgcaaatctcatactttggaaattactgttccagggagtattcatgtgaaaggaaagctgtttgaactatatatatacctaagcctgtaagcagaaatgactggacagaaatacaagcctgtgagacagagagatctaggagatccctagagaggtccatcaagacctccaggatgaaattacctcatttagctcaatttctcacctctccgttagtgctttggtccacgggggtcagtgtttctgcaggatttcaccaactggttccacagtgggaatgtgaagaggtacctggctgtgggaaaagctgcttatcaaagagaggcctgatagaaatgctagggaaagtggctgtgagcctgcattatggacgggagcagagcggcagggcatgttgctaggactaagcagtcgattcacgtgagtctggacaccatgtataaatattttgaaaacttcctgttacaatttaatttactccattgtgttagagggagtgcttccctgcacatggtgttctgtatatttattggttgatgtgctttagggtatagtaattatttatagcaatagattgatacccaggttgcagagttgctttagttatatctttatttccttttcttagagattatagacataatttgcttctgtcatcttttgaccaaaaatctaatgggaatgaagaattacacttgaatgtttatttttaagtaataagttctgtgatagtgattataggtgtctgcatttaaaaaaatgttttaaaaagtacagaggtcaaacaagcatctgtatgattgaacaaatgttatttcgtatatttctgtcaaattttaaaaaatggataaagaggccgggcactgtggctcacgcctgtaatcccagccacccgggaggctgaggttggagaattgtttgaacccaggagacggaggttgctgtgagcccacatggtgccaatgcactccagcctgggcgacagagtgagacaccgtctc

SEQ ID NO: 19665 - DNA, 442 bp, Homo sapiens
acggagtgcaaggtcatggagaataactctactttctgcatacttctaaactgcttttattattattggtatgtttccgtagagtgactccacattcgttattttaattcttatgatagccttgtaaacttacatgttataatcccattttgtagacgaggaaactaaggttttgatgttcttttcccttacggtgagtgaacttgacaactattctcatacatttcttggactgaagggcagaaaatatgagctgttgagacagagtctaatgatagaagatttgaaatgtttccaacacaaagaaatggtaaatgttcaaggggatggaaaccttaaacaccctgatttcaccattacacatgtatgcatgtatcaaaatatcacacgtaccccataaatatgtaaaattattatgtaacaataaatttttttaagaaat

SEQ ID NO: 19666 - DNA, 329 bp, Homo sapiens
aggatgatggatttgaaggtaagtatgtttgtatgtgaaaccataggaagtttgtcgacttagcagtttctgaatgcctactgtgtatttcagtctgctagttgaggaatatgtagtctccatcattgaagaaagttaagggtcagtcttgcaggtttccagctactgtgtgtgtatgtgggggtggggaagtaggtattgttttttatgttgttgtgttgtttgtttttaagagatgtcacctgtcacccaggctggagtgcagtggcatgatcatagcttactgcagccttgatctcctgggctcaaaggattctcccgcttcagct

SEQ ID NO: 19667 - DNA, 405 bp, Homo sapiens
ccttaatgggccaaaatctgctctaatcacagttagcttggtctacatctatattgttctctatcttagactttggaatggaaaagcattcagcttgccagtcttctttatgtttattcccctcattttctaatcatctttctaaattgctcctttttatattctgttggctatagcatcttgatgtaatgatttcagttgctggctgaattgtttagggcaattacagttgtgtgtctctgggtacagttctttgactcctgacaaactagattggaatggaggatattgagacagggtcagttgtcctttgttggttgagaggcatgtgactcctttcagtagttttgggataaatgggagtggaatacaagatgctgtgttccaagaactgagagctagaaa

SEQ ID NO: 19668 - DNA, 447 bp, Homo sapiens
gtgctgagtaaataccaggtaaacaccccaaggactggggtagaccgggactgagtgggcagggaggtgtgggaagcagcttccagcccatgtgaggcagccctcaggccccgcctcacgctccctcctcgatggggtgttggtctggatgagtgaatctcaaacctgactttgcatcagaatcacctccagaaattgttagaaaagccagtgctttctcctcgggcaccctcaccagcctcgtcatgccctaggcctcctaactccatgggacctgaatctacccatctcctcgggccgccagcaaagtgccacaacctggcggcttaagacaacaggtcactgtctcagttctggaggccaccagtccaaagtcaaggtgtctgcagagctgcactttcccgaaggctccaggggagggtcttttttgcatcttctggtggttcc

SEQ ID NO: 19669 - DNA, 2019 bp, Homo sapiens
  misc_feature (1446)..(1446): n is a, c, g, or t
gttggaaggcagacagatctgtgttccctatttgtccctctgggaatatgacataatcttagggggtaggacacaggccaagaatgtcactaactgatttgggacatgagtctctcaccaacaaaatggtaatagaccattcattcattcatcaggaaatagctattaaacacctactatgtgctaagcacgttggtattattgggaatacagtgatgaataaatcatattcttttccctaaagtcactgttactctttccattttacagatgaagaaacttgggctcaaagaagttaagcaactggcccaaggttctactcccataagtggcagagaagggttttgaagccagataccctagttttcaatctctgctttactcttgtgctgtctgcctccccggcatcatgcatttggcaggggacatgatatggacctgttacgtgggcccacagcatccaggtccagcctaagctgggaagatcaaggaaggctccctggaggaggtgacgcctatacgaattctaaagaatttggccaggcagcagggagtgtgtttggctggtgtcataggcagacagcagcatgcccaaagacaagaaggagggagggtttgatgccttcaggaaccaaaataattgaacatgcctgaacccaatttcttaaccagtgagcattgtaagggtagactaaaaggggctgtccttgtgacttgctgacacaaacccttttcccggtgaagaggtgcctgagcaatactatttaattgtatttcctggccagacaacttccaccatctccttaggagacagggtggtcaggaagcaggaaagactaagatgatggggactctctgctgtccccaccttccctgtccattgtagggtctctgcagcctcataccctatgtccagcgacctcccccaccccgccgccagtggaatgcctgaaagtggggtttggcctgggaaagtccaggtaacacttcagattaagctcctcttgtcaatttcctgctacacaagactttctgaatccaagtctctttcctatgaatagagggcgggaggccagattgcccagttggaggtgtggcttcagctggtctccgttgaagtctgaaaagccaacaaagcatagtgagaattctgtgtggttcaagagggtgccttgtgcttgttgaggagaggccgttggcttgatcactcacgacactattactgacgttattatttactgcctgcccaaccacagaaatattctgattcccctaaggagccagtgagcagtaataattttctgtattgcaacaatcctcctaatgacagaaacagatccacctccaggtacgtggtggacgaatgggagcagctggctgctggccccacacttaccaaccttgaccacagggtccacccagcaactccacctcacccatggatcngggggaaaaacaactcacagactgttctcctcttaccaaggttaaaacgcagctggaattactttgggcagtttgtttttaaaaatgagtgttgcaattgtaactgtctcaatgcaagcttcgctgtagatgcccttcttaacaatatgctttatcttctgactgagaaaatcacttgagatgttatcatgcacaatcccacttgttctgcctctccaccctggcaccttctccgaacccagagatcccagagggccagcatctcaccccatgtaactccatgtaattctcccatctaattacaccggctgagagtctgtcttaagaaattcagtgggagctccaggtgtggaggggataaagaagagatggaaatataccaagtgaaaacatcagatttttctaaaaagggatttgtgtattttcctggagtcatgagtcctatagaaaaaaatttatattctttttgttttgtcctttttactggcaagggatttaagcctttggattaagagaaactcaaaagataatttaattccattcttatacttctgcctggataaataattccag

SEQ ID NO: 19670 - DNA, 979 bp, Homo sapiens
gttggaaggcagacagatctgtgttccctatttgtccctctgggaatatgacataatcttagggggtaggacacaggccaagaatgtcactaactgatttgggacatgagtctctcaccaacaaaatggtaatagaccattcattcattcatcaggaaatagctattaaacacctactatgtgctaagcacgttggtattattgggaatacagtgatgaataaatcatattcttttccctaaagtcactgttactctttccattttacagatgaagaaacttgggctcaaagaagttaagcaactggcccaaggttctactcccataagtggcagagaagggttttgaagccagataccctagttttcaatctctgctttactcttgtgctgtctgcctccccggcatcatgcatttggcaggggacatgatatggacctgttacgtgggcccacagcatccaggtccagcctaagctgggaagatcaaggaaggctccctggaggaggtgacgcctatacgaattctaaagaatttggccaggcagcagggagtgtgtttggctggtgtcataggcagacagcagcatgcccaaagacaagaaggagggagggtttgatgccttcaggaaccaaaataattgaacatgcctgaacccaatttcttaaccagtgagcattgtaagggtagactaaaaggggctgtccttgtgacttgctgacacaaacccttttcccggtgaagaggtgcctgagcaatactatttaattgtatttcctggccagacaacttccaccatctccttaggagacagggtggtcaggaagcaggaaagactaagatgatggggactctctgctgtccccaccttccctgtccattgtagggtctctgcagcctcataccctatgtccagccatactccgccgcggcggatatcgcttgaacctggtagcagagctgcagggatcctctagat

SEQ ID NO: 19671 - DNA, 331 bp, Homo sapiens
gttaaccaggctggtctggaactcgtgacctcaagtgatccgcccgcctcagcctcccaaagtcctgggattccaggcgtgagccaccacacccggcacatttgtgctcttttgcttgtgttttctcctctttagctctgaactcatgaagtgccttctgaacatttctagtctggtctcaggggacctgagggtattttcccaccccccaagcctagagagctggggaaacagaggcaggaatgcagacccggtgggagaggtggacaagggtttgggtgtgggacaagcagcagtgtgtgctgaggtttagggaagggccagggtcctg

SEQ ID NO: 19672 - DNA, 196 bp, Homo sapiens
atctttcagggcacggtgcatttattgaatcagagacatcactacggtgctgtattctcagtaggaagaaacttgggtccagaaaccaagggatggaagagagtgtggctgcatgtcccatcccttatattcacccactgtggaacttggacttctcatatcccaaatctgggctttgtagtataggaggtcctgg

SEQ ID NO: 19673 - DNA, 345 bp, Homo sapiens
tctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagct

SEQ ID NO: 19674 - DNA, 228 bp, Homo sapiens
ggtttctccatgttggccaggtttgtcttgaactcctaacctcaagtgatccacccacctcagcctcccaaaatgctgaggttacaggcctgagccaccacgccaggccgggatcaatggatttgaactccctcttctgtttttcgaatgcaaacttactatatgatacgctacattgtcatcttccctcattcctttcataatagaaaaactatcttttggtgtcac

SEQ ID NO: 19675 - DNA, 3144 bp, Homo sapiens
caatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactatcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaaggccgccgcgatcatagacctagatcccgacttcgaaccccagagccgtccccgctcctgcacctggccccttccccgaccagagatcgctaaccagccgtccgagccgcccgaggtggagccagatctgggggaaaagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagcagtg

SEQ ID NO: 19676 - DNA, 2349 bp, Homo sapiens
  misc_feature (42)..(42): n is a, c, g, or t
  misc_feature (51)..(51): n is a, c, g, or t
gctggttataggcatttattgaatttattcatttattgattngacacactncctcactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagcagtg

SEQ ID NO: 19677 - DNA, 3305 bp, Homo sapiens
caatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactatcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaaggccgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctctcagagccggccgggggcccccagcccggaatcctgggggctgtaacaggtcctcggaagggaggctcccgccggaatgcctggggaaatcagtcatatgcagaattcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagcagtg

SEQ ID NO: 19678 - DNA, 1966 bp, Homo sapiens
caatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactatcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaaggccgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctctcagagccggccgggggcccccagcccggaatcctgggggctgtaacaggtcctcggaagggaggctcccgccggaatgcctggggaaatcagtcatatgcagaattcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctacccagattgtatcatgtgctagattggagtggggaagtgtgtcaaatcaataaatgaataaattcaataaatgcctataaccagcagtg

SEQ ID NO: 19679 - DNA, 539 bp, Homo sapiens
ctgtcactcattgcattctgtttcccccttagacaggatgtgtgttgctcagatacagagttgagagtccgaaagatgtcaagtaaaacactaatttctaactgccttcctcagttgtcaaatattcatgttaaaaattgttctggcacataatgagaaatttgtgtgaatttattggtttaaaaaatatagctggctaattataggtttaaaaaatatatagaaatgaaataatgcatctgtcatatgaaaaaaattactcttcaaagaaactggaaaatctcttattttctgtttataccaaaattctaaatataaacattttaattcaaaaggaaagatagatattccttataaaaacatctaaactatttaaaagcctccaactggctttaaagtgagtgaagaatttttcattacaggaggctttaatgcataaaataaatttttacttaaaatttatagtgagaaatgcttggctgaaacaagaataacctttaaaatgaaccgggtttcttctacacataaattgcaagagg

SEQ ID NO: 19680 - DNA, 367 bp, Homo sapiens
tggcaaagatgttctatagatagtattaatacaaaggtatctggatcaagcatttgattttcaaatccttctctgacacatgttaacctttcatttattcttatgtttttggaaaagaatgccgggctctgcattttctttctggaatctctctcccatctggctcattcccctaccacctcttccccaaatgagttctgttgctattacctcatattagtactgacccatttcatttggttactgtagtacttcttaaaataatcactatggctctagtatctcctaattcttcttcttcttcttttttttttgtgacaaggcctcactctgtcacccaagctggagtgcagtggtgtggtcatgg

SEQ ID NO: 19681 - DNA, 743 bp, Homo sapiens
taggtagatagagcaagtcctgctaccataagtttaaaattattaagacaacgggcttttttaaattgctggtagaaccaaaggctaattttgcataggtttatatttttagacttaagaaattagcacctatataataccttcataccttctgcatcactatcaatttttctgtaatttcttatttgaatgcttcctaattctttacagaaaaaattaaaatttgtcacccaaccaggtgataataacaaaacaataatttaggaacatccagtaaatttggaattagttctctaaatttgggtaattaatagcttattggataattaaaatcagccctaatgttgccttaagtaggaggaaattggatcagcaatgggattgggtatcctattttcctttcctataaaagtgctgcctcttctcaaattgctttatttctctcccactgcattagtatatctagaacagcaccttcaactgcaacaaaatataattctcctagatgactaggatatcctccaatctggtatcatgccaaacaacactatgtttggggaacagcacccgaaatgctgctaaaaagctacctcatgtcaagaaaatatggatttcaaaaaatatctggcacagtggcccatgcctataaccccagtactttgggaggccaaggcaggaggattgctggaggccaggagttcaagaccagcctgggcaacatggagagactccgcctctacaaa

SEQ ID NO: 19682 - DNA, 370 bp, Homo sapiens
gctgatcttataggaggctttggagtatgaatagcacctcgagattgttccaccatgtaccctcattgctggatcattggctgcaggctgccccgagggaatggagtaaccacctacacgtttccttgctccctgcagctgaaggcaattctgttagaagccaactgtcacagcagctgatgcgattattatttgggttggggaatggtgtgtggtcaggggatgaggatttgctttgtgcacattctactggtcaccgtctaataccaactcatgctttagacatcagctccatgacagtagggatcagaaatgcagaactagggaattaaggcaaatgtgcgtcatctcccccttctcttagaatctg

SEQ ID NO: 19683 - DNA, 638 bp, Homo sapiens
  misc_feature (11)..(11): n is a, c, g, or t
  misc_feature (17)..(18): n is a, c, g, or t
  misc_feature (22)..(22): n is a, c, g, or t
agcgcggccgncgggcnngtcncgggagtgatcgaagggttagttttaggtgcagtatcatctctacctaaatgaatgaagaaatggaaggatatttgtagatatggggaaaggaatgaagagaatttttttctgttaaatgaacagcaaatccttcatcaccatcaccatcatcattttcaggaactcacaatattaatatttagagataattttgtgtcagtttttattccatgtttttaataatcacagtattttagataagcaaaccaaggcacagcaaagaagaaccatactcaaagttttacacactctagaaaatggtggatgtgagattcatacccaattcacagtccagtcgtgagccttctgctgagagaggagtggagcaacattgggaaggagggacttaaaatgtatagggtagtcactgtggggacattgaggggacttgaccagaaacaggatgaaagagttggtttaatggtactgagggtcttattaacattacttacttgtaggtccaccagttcacaaaaccatgtgctataaatgaagtaacctgccatggttcaggagaaaaaaagagagagggttacattaatgaaaagttacagtgtgttcactagcaaaaaaaa

SEQ ID NO: 19684 - DNA, 1118 bp, Homo sapiens
actgacagaagtagaaagaatataggaagaactgaacagtaggggtccaggtaggagtccatcctttccatgccctagtagggacactcgacgctcaaggaaaatatctcaagatctcctcctctctgtgcatggtctctcatcccttgagtgacatgatgacatataaaacattcttagaatttcacttgaggcagatattactaattaattaatcaaagcaagcatgtgaaatggtatcaatttgccaaaccaggttcagacattgtgcctcaattcagaaataatagaattatgcaaatctaaaaatgtgaccctcaaaagtgtggaatacctctgcttgaggtaataccgctcctctccttcagctactcactcaactctgacaaatcgtaactcagtttactccctatatccccaagctttctttgttaaaagaaattttgaactacttgcttttgaaagtaactcacatggcatgctcttagcatcatctagcacaagctttgttttcttctgttcaacttcctttcagaggtgcatttttacaacttccctctattgttctcattgactttccgggtttgatgcgacctgaaaaactctcctttctgaaattcgttaaccagcttcatcagttttatagcaaggactggaagcaccaatttaaaatttaaatggtacaatgataacttcaaattagtttgatcaattattttaggaaattccaaaaactgaaatttcaaatattgaaatgcaggaacttccttgcccctccctggctctataaataattaaaataaaaagtttcctcacaggaaatatataaaatatgtttgttttgttttgctttagtggaggaaaagagtgtaaatctagaactaataatttggggttttctttgtttgtttccacagaaataatcaatgattccacactaatagaaaccatttgtcccaactgaaataggcaaaaacacggttctgttccaattttacaatttttttttgtttcttcacacaacaccgtggtgatgcagtgtctagactttttggaacaaggcatggagtctggaatttattctgtgggtttgaaaatggttattcagtgctcctaca

SEQ ID NO: 19685 - DNA, 932 bp, Homo sapiens
accccactggactcatggctccagcttctacccacccgtctgtactactgaatctgcacctccagccctcccatgatatcacccagatagcctcacctgggggcttcacaggtaaagcaaaatcagtccccaaatcaaaatcatttccccaaacctgcgtttctcttcgcccttagaactggtatctccatccacacatggctcctaccagagatctaggagtgattccctatccttccctctcccactccccatctccttccagtcaccacatggggtccatccagcctcatcaatctcacatacttttggccttcttgttgccattgcctgagttaaagctctcttctcttccagcccagataatggtattgagtgtctagatggtttccccgtccctagttttgttgttctccagatccatgccagcaaggccactggtgacccaataggtacctttgtgcaaattagaaaaagatgctcctagccgggtgtggtcccagcactttgggaggcagaggcagaggcaggcagagcacttgagctcaggaattcaagaccagcctgggcaacacggcgaaaccccgtctttacaaaaaatacaaaaattaggcaggcttggtggtatgtgcctgtagttccacctacttagggggctaaggcaggaggattgcttgagctcaggaggtctaggctgtagtgagccgtgatcacaccactgcactccagcctgggcaacaaaaacttaccctgcctctaaaaaaaagaaagaaaagacaatcctgcctcaagacacttttttatatttagagacggagtcttgctctgttaccaaggctggagtgcagtggtgctctcaaggctcactgcagttttaacctgggctcgcagttttaacctgggttcaagtgattctcccgcctgagcctctc

SEQ ID NO: 19686 - DNA, 274 bp, Homo sapiens
ttttggtagagacgaagtttcaccatgttgtccaggctggtcttgaactcctgagctcaggcgatctaccctccttggcctcccaaaagtgctgagattacaggtgtgagccaccccgcccggctgtagtttttcatattatttgtataataggttaggttccagcctgggtgacagagcaaggctctatctcaaacaaacaaacaaacaaacaaacaaaaaaccttagagaaaaatgggaaattgctggctcagaagagggaacaggcaaaaa

SEQ ID NO: 19687 - DNA, 489 bp, Homo sapiens
aaagagtgctgacgtactactcatctgaacagaacctgaaacaaaccatgatgaaacgggttcaatactcttccactctttatcacttataaagtttatgaagtccttctgagtccttggaccctgaggatgcctaaattcaccatctttacaatgataaatagtaggaagaacagttattgtaaactgtccagtcagtcctggctgctctgtgacatctactttcacaacattaacctcagatcttctccccattcagcaaaactttcccattccggttaatggttttgacaagcagggcaccacggggcataaaattgtatcatccagcctccttccagcagctctctccagttcttgtctgtgatgatgcgtacgttgctctgccgcctgtgggtccagggagcacccccaagcaacagtaccaggactgccagcggaactgcaagactcctggagggtgccatgtctgccgcttgcccacctcac

SEQ ID NO: 19688 - DNA, 573 bp, Homo sapiens
gataggttttcaccacgttggccaggctggtctcgaactcctgacttcaagtgatccactcgcctcggccacccaatgtgctgggattacaggcatgagccaccgcacccggcagatagttttaatttaaattcagttagacaagtgcatgtggtacacccattatgtgacgcttcatattatgtactaaaagcatgctatgcacaaagtgtaggtgtacagtgatggatagatcctgccctatggaactaacaaattagcaagcgaaatcaacatttatcaagtaattaaaagtagtttaagtgttgtgaaggaaaagtacaaaggcttatggaagtgcatatccaggatgtttataaaccaagggaggtcgaggcataaaatttctgaaagcaagaatgcagtgttcctacatttttactaatattccaagttctgaaaacgtgtacttaagtagcagcttttcctgagtttattcaatttattgcattatcagtgtagtatgaatgggagtgtgtgatgatttccttcaaatataaaaggaaatttcttaatgctgtgttttcttaaggt

SEQ ID NO: 19689 - DNA, 343 bp, Homo sapiens
taatcttgggaaagtgttaagcatatcaggaagacatatttcttctagcttgatagaagagtgatgaatctaggatgtgacctctgctgtgtgagctgatgtctccctgatatatagtggctctgtgtgtgtttgcatagagagggaaagaggatgcatccgtgtctctgtttttcttcccggccgttcccaacagtgactgggtgattgaggggctggagcacgtgcagctcctcacccacgctgaaggcatctctagtaatggcatctggcccatatgcagatctagctccactctgtgctgacatcagccggtttgtggcacctcagcgtatttctgggt

SEQ ID NO: 19690 - DNA, 269 bp, Homo sapiens
gtacagtagcgtgatcacagctcactgcagccttgacctcccgggctcaagacatcctcctgcctcagcctcctgagtagctgggactgcagttgtaagccaccgtgtccagccagtttctgttgtttgaagcccccagtgagtgcaggtttgttacggcagccacaggacactaacacagatctggagggggacctgggcagaggtgggggacagctctggagcctgaggctacctcctctggcttctcaggggagcaggtgagcatg

SEQ ID NO: 19691 - DNA, 272 bp, Homo sapiens
tcagatttggggtggctcagcttccaggtggggcttccagctccagctccagctgttgttgattggggccagggagggctccagctccaggacaatgggagaggacttgtaggtacagtgggaggcagttctttgtcatttaaaaacctattaggaaggaatctgaaaatggtcacattgtaatggaaatttctgaaagaaatatttgtattttgttagggatttaagagatcaaaactctacttatgttctttgaacactggccaacaggc

SEQ ID NO: 19692 - DNA, 586 bp, Homo sapiens
aaattgaaaatgtcagcattggaagtccccataaatgctgtcaactccaacaatgcatctggctcttaaatcttccatacagtttctctaagtggttgcccacattgtgattaaacacagccaatgctcagaaagcaaccacctgctaggcaacccatgccacctctcggctgcccggaagctgtctgcccccttcaacagccatcagattaccacccctccacagctgacacccaggccctgcccatctaccctacaggacatctcttgtagggtgttttgatcttcccgggcatctttattgctaccaacttaatagtgtttcagcaaatgtttatgaagctccatctgtaggtgccagcaacaataaaatgataaataaggaaaataacaggaaattacatatgaataggcacttttaatacaaggtgacgagggctttggtgaagtatgtgtaagatattaggggaacaaagaaagtttattacttacctactatctataagcactgaggatacaaaccaatattccctaagggatacagagatattctctgcccttcagaagcttatagtctaaaaaaaaa

SEQ ID NO: 19693 - DNA, 448 bp, Homo sapiens
caaggtttgatgggcttgccatctgagtttaagtggaaatgcagaatgtgcccataccagcctgggttacattgtcctcttataggggcctcaagcccagcagcgagctttggctcccgagttaggcagactgtctcggctggcatgtggcacacggcaaggcacttcattgcttcagagctccttctatgccataaaaagccctacaagacctggtgctaatccctctctctggcctgttctccctcacccctggcccaccctgctcactccactccagccacactggctgccttgctgttgttcctcaaccacagctggcttgtttccaccacagggcctttgcatatcctgttccccaaacccttcccatggctggctgcttcaccactcaggccccagttcaaatgccacctctttggggaaagcttccatgattccctgactt

SEQ ID NO: 19694 - DNA, 381 bp, Homo sapiens
gtttttggagtagggatgctcaactggtaagtataatgcaaatcaaaatctgaaagacttctggtcataagcactttgaataagggatactcaatctgtatcaaattctagaaaatttggctgggcgtggtggctcacgcctgtaatcacagcactttgggaagccgagatgggtggaggtcctgagctcaggagctcaagaccagtctgggcaacataggaaaaccctgtatctactaaaaatacaaaaaagtagctgggtgtggtggtgcgtgcccgtagtcctagctactcaggaggctgaggcatgagaattgcctaaacctgggaggcggaggttgcagtgaactgagagcccctgcactccagcctgggcgacag

SEQ ID NO: 19695 - DNA, 1908 bp, Homo sapiens
  misc_feature (233)..(233): n is a, c, g, or t
  misc_feature (572)..(572): n is a, c, g, or t
  misc_feature (575)..(576): n is a, c, g, or t
  misc_feature (582)..(582): n is a, c, g, or t
tgagacggagtctcactctgtcgcacaggctggagtgcagtggcgcaatctcggctcactgcaacctccgcctcctgggttcaagcgattcttctgccccagcctcccaagtagctgggactacaggcacctgccaccatgtccggctaactttttttggtatttttagtagagacggggtttcaccgttatctgccaggctggtctcaaactcctgacctcatgatcccccnacctcggcctcccggtccacttttgttttagcttgagggcgtacgtgtgcggctttgttacaagggtatgctgcgtggtgctaaagtttgggcttctatgaatcctgtcacccagacagtgaaccacaggaagtaatatgcccagatagtatccaatagaaagcatttcagcccttcctccccttcctccctccctccctccttctggagcccccagtgtctactattcccatcttttttatttgagacagtgtctcgctctgttgcccaggctggaatgcagtggcacgatcacggcttactgcagcctcaatcttctgggctcaagtgatcctcccnacnnagcctnccaaaacactgagattgcagccatgagccactgcgcctggccaggtttgatttctgtagtagctgttcaattgtgggtcaagggtcaggttctggggtaaggaggtattgggcttctcacatttaaggtcagaagtccagtcctgggtcaggggttgggatcagagatcaaggctgagctctgagtttggaggtcagggattggactctcagtgattgaaatccttaggtcagaggtacagtcactgaggataggagtcaggagtggagttcgggacagtcaaagtcgaggttaagttttaggtcatcacctccttccgctggggcacgcggcgccaccagacgtggtcgcaggaggagcaggcaaactgccggtccacagcagggataaggtcgtcctgggcacgttgaaacatgcgtaggttggcttctgtcagtggcaggagggaggtcgccactgcctgtggaatggggcaggtggggatgaggtgggggggtgtcaccccttctgcaccaacataagcatcagccctcctctccctacagacgagtcctcttcctgccccagtgaatatctcccctcctgccctaatggacatccttctgtgcctgcagatgtccccctcccaactcccccatcccaagccctagccaccaactcacctgaatgtcccggtcctgcttcatatcttctggtggatcctgggtggagatagcaggggcagaaactggggatggggctcaggcctctttccacccgtttgctgggggaggcccccggccgcaatgagtagggtgcccctaactcgccagaagctcacagagcaccactcacttattgagagccaggtgtgtggcctcagttgtcctcatagcagccctgagaggtgggcacacctgttaccttattgctcagatggggaaactgaggcttaggggagggcttgcctgagtgaggctagcctgacccccatactcacttcctgcctgcaaatgccacatgcttgttgatgttgtgacatatcgcccctttgaggccacgttgtgctcggctaagtgggagagagatgtgggttcaaatcccagctgtatcacttccagctgtggggacttgggcaagccactccctgccccctgggttcccactgacaggcatgttagagcccaggctctgactccaggtggccagggttcaaatcgcagctgcccctgcttgctggcaagtgacttcggcctcagtttctttgtctgtgaaatggggataaataataggacctgtctcctggggtcactgcagtgatgaaataaataaattcctggaatcttg

SEQ ID NO: 19696 - DNA, 490 bp, Homo sapiens
ctgcagtgagctgtaagtgcacagctgcactccagtttgggtgacagagcaggacctgtctcacaatacaaataaaaatacaagtaaaataatatctcaagtcagagccttttggctctgcagcccttgcaacccctcagccgtgcagtggggtttgcatccctgggaatgaggagacccctgcccggtgttgttgcctgattaatcagtgttttaaaacatatattaatcggggtgggcgcggtggctcacacctgtaatcccagcaattagggagacccaggcgggtggatcacctgaggtcaagagttcaagaccagccttgccaacgtggcgaaactccttctctactaagaaaatacaataattagctggacatggtagtgggcacctgtaatcccagctacttgggaggctgaggtaggagaatcgcttgaacctgcggggtggaggttgcaatgtgctgagattgcgccacttcactccagcc

SEQ ID NO: 19697 - DNA, 431 bp, Homo sapiens
tgtgaccctcatgtttatgttcacagcaaggctgctggagcttcagccagcatattctcatttcaagtagaaagaaaaggaaaggcaatagacataaaatggaagtgctttccctgacacctcatccagtgattacacttacatctcattggctagaccatgtcacaggccactctcacagagaaagaggttgagagatttttttttttaaaagagaacactgtcattcccaacacagggttaaattagtaacagaaagagaagaaaacattgacattaagtaggaattaacagtatcaaacatacttcagggagtatttgtgccagggatttgcccattagtttaaaactatacttaatattatggtattattcttaccatcttaaaagatatttaatattctaatatataatatatgctcatggaagac

SEQ ID NO: 19698 - DNA, 85 bp, Homo sapiens
aacaggtgggtagcatatacagcatagatacactggacaaagggaggactcacatcctgggcaagatggagcagaatggcagagt

SEQ ID NO: 19699 - DNA, 339 bp, Homo sapiens
ggcaggagaattgcttgaacccagaaggtggaggttgcagtgagccgagattgcaccattgcactccagcctgggtgacaagagtgagactctgtctcaaaaaaaagaaaagaaaagaaaaggaaagaaaggaggaagcaggaaggaaattgtcacaccttctatactaagtgttgtatgccaaacctaagagagctaaaactgattggcagcatgggtcattgagagggaaagcccttgttttatcttttgccagctccttctagatctttcctaccagaaattcgggtatcaaaatgccaccctaacagaagttataatactgtttcccatccctcc

SEQ ID NO: 19700 - DNA, 489 bp, Homo sapiens
cattagctccagctccggaagaacgcatgcgccaattagagcatcaaagccctctccgcagagcttgtttccataaaatggagcggatcacaaacaataacagttctccagaaactgcctccctgctacagaactcaacccccaaacccagacgaactccacgctataccttaagccaccactaccattttcttggcttataattcttttggagtatgaatagtgggttctctatggactgttatgatttttaatgtaatggtactgtagttgagtttctggcactgaacaattgctgattttctaaacagttatattactatcaatctctgacatcatcaacaaagagaattcataggattcctcctcaaatatatggttttaaacattttaaaaaataatttacaaagccagaacttaaattcaattgtaatatatctcctcaaatacaagatgtgaatgaaataaaatgacttctttaaatatata

SEQ ID NO: 19701 - DNA, 210 bp, Homo sapiens
aatgattaaaactcccccttcaaatcaaatatagacacccatacatatacagacctcaaaagaaaaatttaattgggtaaaactgtatactacaccaaaaacttaagaaacaagcccaaagggaaagcatttacgttcccgaacatgcaaattcaaacactatttcagagaaattattttgaggtctgtctcttgaccagatcccttcag

SEQ ID NO: 19702 - DNA, 305 bp, Homo sapiens
actctgaaggttatattgggagtgcccatattcagggagtgcctataatcaggccttaggtgctcttgcagagaagttgcccacactcagtgggtgtcctataccatcaggttacccaggccgcacactacctgtataaaacacctgttggaaacaccatcctttaccaagtgtaattagtgtaagttagcatcaattaaccaaactggggataattttcctctgttttatttggagatgcacctcactaagtggctgtggattagcatccataaaaggtggttaaaggtaattcatttactggt

SEQ ID NO: 19703 - DNA, 252 bp, Homo sapiens
caggctggtctcgaactcctgacctcaggtgatccacccgactcggcctccaaagtgctgggattacaggcgtgagccattgtgccccgccccctttttaacctagtttgttgtctctcaccccgaccagaatataaccttcatgagggctacagtttgttgtctatttattgcccaactccatgtccttgccacacagtaggttcccaataaatgtatgttgaataattaataaagactacattctaatga

SEQ ID NO: 19704 - DNA, 631 bp, Homo sapiens
tgatttccagatttgctgaaatcgaggttgcggctccagcttctgccctgggtttggtttgttgttgtcgtcgttgtttttgagacaggatattgccctgtccctcaggctggagtgcagttgctgtgatcatggctcactgcagcctcaacttccctgagctcaggtgatcctcctacctcagcttccccagtagctgggactacaggcgtgcgccaccacacccagctgatttttgtatattttgtagaaacagggttttggtatgttgcccaattagtctagaactcctgggctcaaatgatccacccaccccgaatgctaggtatacagttgtgaaccaccatgtccggccctgggtttgcttttgattgtggtcttttctgttttgaattgccttactcctcttagagttcagccagtccagacggacaaatccatttctagtgatttggttattttaaacactatttagtccccagagaagaaatacaatctttctgtcctagtgcaatttataagagtaattgacatattgaaatagtggatatgacagtttagcctgataaaagttgtcagcaaatgaacgaatgctgtccaccgcatacccagtgttttacatgcagtattg

SEQ ID NO: 19705 - DNA, 97 bp, Homo sapiens
gggaaatggaaaaacatcatatagaatggtaggtagcgaggtaaatattatggttaatttgatgtgtcaacgtggctaggttatgtgcccagctgtt

SEQ ID NO: 19706 - DNA, 447 bp, Homo sapiens
gctgtgcattatatgtactcaaatttttattgaacatacttataaaatgagaagtctatggataaactcttcactcttcagtgaaactttcttctccttgatgaattatatttaacacaaattaatcattaattcatttcaccaggtgtgtatccccccaaaaaactgcatttctgtatttaagacagatgatgacatgcactaatgggagaaatcacatggcattacaaaaaaacacactgggtagggaatcagaatgactgggtgtctggcttgctctgtcattaactaggcctactttcttgtttataaactagttgtatcagattagtgattctctatgtagaagagagtttcacaattacctgggaactctttcaaaacatacatgccctgccttcctggggtatagtatgtaagtgatggagggagttgtctttagttaaa

SEQ ID NO: 19707 - DNA, 595 bp, Homo sapiens
atggctccatttgtccgtaaccttgtggagaagaccccagcactggtgaatgctgctgtgacttacttgaagcctcgattggccgcattttggtactacaccacggttgagctggttcctcccacccctgctgagatccctagagctattcagagcctgaaaaaaatagtcagtagtgctcagactggtagcttcaaacagctcacagttaaggaagctttgctgaacggtttggtggccactgaggtgtcgacgtggttttatgtcagagagatcacaggcaagcgtggcatcattggctagaatgtttgaagaccagtcttaacatctgattatatttgatttattatttgagtgttgttggaccaggtgtgatcagactgctatctgaataaaataagatttgtcagaaattccaaaaaaaaaaaaaagtgaatcaagcagttccaacccatgttcaagggtcaactgtgtctatattttgaaccatttaagagtaagttgcccctttgcccctaaatatttcagtgtgtatctcctaagaacaaggacattcctttgcgtaaccacagaataattacaggaaagtaacatt

SEQ ID NO: 19708 - DNA, 1904 bp, Homo sapiens
gagaccaccttgggcaacatagtgagatcccagctctacaaaaaaaaaaaaattagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19709 - DNA, 866 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacataggtaaagtaacatctttttctcaatgatgtttgaaaatagtggagacagtttttgttttactaaaataatcttatattttctttcagaacgtgttatgaagaaatgttgaaagagtgagtgtttgggattttaaaaataattgtaagatgtttgacttttttgtgtgtgtggtgtggggaggtggacaaacattgttacttatactat

SEQ ID NO: 19710 - DNA, 611 bp, Homo sapiens
gaggatccctgatgcattagaccttaaaatagttcactgcataacatgacaaaaagcacaaaggctcattcagagaacatatttgttgttctccaacactgtaatagttataatttcaccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgcaatcatgattgcatttagaccaggcaagaaaaatagactccagtgctgtaatttttttcactggaggagtgctaatgttgtatcaatctttacagtatccaaatacacaatgaacaaaagttagcccccataagagatgaaaattgtactacctggaatgtgcacaattgtttgaaacattttcccgtttttgtgtgataaaagcacaattctagggtggagggtttcatactaatctggaagtaagtttgtcagaagaatcaacgttat

SEQ ID NO: 19711 - DNA, 4445 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19712 - DNA, 1470 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtg

SEQ ID NO: 19713 - DNA, 4487 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggtgacgccttctatggactcttccctgacaagcttccgtcaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19714 - DNA, 4401 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19715 - DNA, 1705 bp, Homo sapiens
  misc_feature (1670)..(1670): n is a, c, g, or t
  misc_feature (1684)..(1685): n is a, c, g, or t
  misc_feature (1692)..(1692): n is a, c, g, or t
  misc_feature (1705)..(1705): n is a, c, g, or t
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaatagccacgaatgcggccaaattttcctttttttttaaaantttttttttttttnnttttttnttttttttttttn

SEQ ID NO: 19716 - DNA, 4418 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19717 - DNA, 1443 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtg

SEQ ID NO: 19718 - DNA, 4374 bp, Homo sapiens
atccgtctgccacgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19719 - DNA, 3842 bp, Homo sapiens
acctgaggaccctacctaaatggctgtctgcgatgatgcagcatctttgacatagaacgtgtgatgacgaaatgtggagaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaacagtgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttctttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgtttgaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggccataggtattcactagttgaatagtttaatttgaaatgaattaattttaaatgggagttgttcaaaactatgccactttatttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaactg

SEQ ID NO: 19720 - DNA, 1320 bp, Homo sapiens
cttcctagcaaggaaggaaactcccagagactctgaatagggtggtcaggatggaagttcgactgcagggacagagggtgatgatggctgaagctgcaagacacactcatcttagatgaggaagggagatggcagcgtggctggggaaaacaagcatgacacctagttttccaaacgagggaggggaagcaaccagtagaaatgaagcagtgggacattctagagggaaagcaagaacaagatctcccagggattgggaagaaacagaatgaaggttcaaagcattgccctcagagagaagatgggcccctccctgtctgagagacacaatgccaggcacagcagggtgtgtggggctggccagactggtcacccctgctcagaatgtgacagttgttccagtctttccaatggattgtggtcacctatcctggagtgtccataaattagatcagacttttcagtcttgaagaggggcagagagaagcgagaaagtgattgcttggttttcccactccagttaagacacaagtcgccctctcttagattccagaattgtggaaagccaaatcttctaaaaaggtctggtgagctttagagtgaggaacggggaagctatttcggaagaactagtctctgcatgactgatgggcaggacgtttcctcgtcaattttctggggcaagaccgatttggatttgctttgattccaccacgtcatgggttctcacgacagaggaaagaatagtcaatccaaaccctcacattagccggagttccaattttagacagatgttccaacccacttcccacaaacccgcttctcttaagaattctagcaagtggaaaattgaatttcattttctctgctgtccctctcctggggatgacagaaactgggttttgaaggagaaaaaagggtcccaggtaattcacccagagcagtgaccacatagttgagggttaagaacaaactgatccccacaactcaacacctgttgggtagctccacctggtaccagcaagaaaagggggggctggcaagcaagcattcaagggtattttccctgctctaacaaggtatgtttaattctacaagaaaactgttatttctctgcatcattttccctcttgacttcacctttaatgcacactctatagacgtcctgttgtttaactttgtgcttgcagttaagtgttagcattttgaacaaattaatgctgacttcctcttttcctataaaggctgcaccctctggatgtatttcagtgattatactaattcctgcatcaataaaatagaattacttttacttaaacg

SEQ ID NO: 19721 - DNA, 427 bp, Homo sapiens
aatgacatgctcatggtcacacaaatagtggcattgtctactgactggccatcacgctgctacttatctttatttttaggatgagcaaagtaggtcatttgcctctgagatttggtgtaaaggctaagatcatcaggtgcctcaattttggccaatgaatgggcaatttccgaactttcttttcctcattccctgtatttgacactgttgacacctcattctttcttgaaattctctgttctttctgtttctgtggctgcatggtccctgttctccttttagtctgagctttattatttatttccttcaggggacctctttatgttttcactccttaacactgagcctccagaggtctgcccttagcccactgttctttgccctcttcaccttctctttggacaatctcaacatttatttagtgatt

SEQ ID NO: 19722 - DNA, 285 bp, Homo sapiens
gtgaagttattctgtcaattctcaggactctatgggttaaaaacaattgtgctgaagtcttaatcctttttttttttgagacagggtctccctctgttgcctaggctggagtatagtggtgttatcaaagcttattgcaacttcaaactcctaggctcaagaggtccgtcaaccacagcctccccagtagctgggaccacaggcgcacgctaccatgccaagctaattttaaaattttttggaaagatgggccagtagtaagacaaagcaagtagtaagcaagac

SEQ ID NO: 19723 - DNA, 383 bp, Homo sapiens
gtatgtttgcctacctgcatatgtgcgtatatggtagaagtagaccaagttttcaagttacgtgtgacatattttcatagcaatttggaatgatcaaaggaaattgtagaaaatacagtatggtcccagttatttttttaaagaaaacacattatactacaaaaatgatgtactttatatatgcttgtaaaaggttctgaaaggtatttactaaatgttaacagtggttacctgtgaaaattgggagtgtcatttttgaagcaggggagatattgatctttttctgacttatttgacaattttaaatgagaatgattcttgctcagataatttcactatttgtgaaattaaaattaattagtaatgtattgaactaaaaaaaa

SEQ ID NO: 19724 - DNA, 453 bp, Homo sapiens
gtcaggagattgagaccatcctggctaacacagtgaaactctgtctatactaaaaatacaaaaaaattagccgggtgtggtatcaggcgcctgtagtcccagctactcgggaggctgaggcaggagaatggcacgaacccgggaggcagagggagcttgcagtgagctgagatcgtgccactgcactccagcctgggtgacagagccagactctgcctcaaaaaaaaaaaaaattttttttttgttagcgtgggtaacagggagacctcattgctataaaaaaattaaaaagtcagccaggcatggtgacatacacgtgtagtcccagctactcaggcagctgaggtgggaggactgcttgaacctggcaggttgggactgctgtgagctgtatttgtgccactgcattccagcctgggtgacagaatgaggcattgtctcaaaaagagaaaa

SEQ ID NO: 19725 - DNA, 422 bp, Homo sapiens
ctaaaatgtgtttcagtgggatgagatggacttaggggaattggggttagaacttgagggttattttgtgaaacatgaagggacttagagaaaggaaatcaacagctgcataaatgggcatgtctctggctggagaaatgtggagaatggagttctgatacactgttagaaggatcttatgtagcatttttatagctgacctagaagaacacaaaatttccaaggctgtgttataatgcgcttttccaggtaaaccaagaggaatataccccaggaaggttgcataattaggatcaagtgttttcaagttttcatattccaagctttggttctatgcctacactgttcaatccagtagccactagctacatgtgagtatttaaatgaaataaaggtaaacatctagcttgtcaaccgcacaa

SEQ ID NO: 19726 - DNA, 2905 bp, Homo sapiens
aggctgtacggtcgcaagtccttaatcaggagaaaggaagcccttttgtcagatgctgtggccacttcctcttcagaaggctccagccaacctttcggtttgcagagatgactggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttctattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 19727 - DNA, 2586 bp, Homo sapiens
ggcactccttgggtgtgcaggatctggggtacttcggatgatttaaggctacagactacacacaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttctattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 19728 - DNA, 2928 bp, Homo sapiens
  misc_feature (82)..(82): n is a, c, g, or t
  misc_feature (341)..(341): n is a, c, g, or t
ctttcgaaaaggagctttgcttcccatgacgcagagggaagtgctcactgggcatatttgctggtaaaactgaaagcaaganaagcagggtgctagcccctgtgggactgagggtggaggctgggggagtttgggtgccatcctccagtgacagatgcgatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaanctggagcaaaatgtccctaaaattgccaaggaacgggatttcacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttctattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 19729 - DNA, 2811 bp, Homo sapiens
  misc_feature (82)..(82): n is a, c, g, or t
  misc_feature (341)..(341): n is a, c, g, or t
ctttcgaaaaggagctttgcttcccatgacgcagagggaagtgctcactgggcatatttgctggtaaaactgaaagcaaganaagcagggtgctagcccctgtgggactgagggtggaggctgggggagtttgggtgccatcctccagtgacagatgcgatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaanctggagcaaaatgtccctaaaattgccaaggaacgggatttcacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttctattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 19730 - DNA, 444 bp, Homo sapiens
tgccagtccaaactctgaaactgggcctggaaaaaagaactctggagaagaggaaattgattctttgcagaggatggtccaagagctacgaaaggaaatagaaacacagaagcaaatgtatgaggaacagattaaaaagtaagtcagacagaggggcactgagaggcacttggcttccatctttagagacaagagggattgttcccatccgccagagaagtcacatcataaagcttcaatttggggaagacagtaatctatagcaggcctagaaagaaaagagtaaagggaacaatgagatagctaaattggtgaacactctaaactttaaactagatttaggaaatgtaaatatctagcttaagtagtttaatcaataatttccaaacagtggttcaagaatcaacatgctttaattaatttaaaggaaattaatttttttta

SEQ ID NO: 19731 - DNA, 422 bp, Homo sapiens
agcagaatcaaatttggaaccatgctggtaagaaattctgggagtgtagcttccaggcaatgcagggaaaagtgtataagggggcagagatgatgcagaattgatgagacaattcagaacatttgcaaagaagaatgttaggtaaatattgaggtcatccagatgtttccccacccaatttttatattttgtgttctaagtttgcctgccttaatgccccatatctacacgcagacacacagacacacacacactttcaaccaaaaagaatggctagagaaatattgaaatacaatgaatgtacttaatttttaaagtttatcacctgcatacttaagagataatgctaaagcatgagtcatcgctgacatttagcaccactaattttaaaactatgcagattattgctttgaggaatagca

SEQ ID NO: 19732 - DNA, 697 bp, Homo sapiens
ggaggttgcagtgagctgagattgcaccattgcactccagcctgggtgacaaagcaagactgtctcaccaaaaaaaaaaagaaaagaaaaatgaatccactaaagtaaatgattggacttatgcttgtggaagcatgaagcagatacagttttccctattcctcctgctaaatacatctaaacaccctggatattacatgtaaaaacaagcataagaagactctcaaagatgtaaggaagaaagcagaccacctaaggaccttgtaaccaagtgacctaaaagtagtaagttcagggttttcttttctgcctcgtatacccaaagttggaactgaagaagctggcaacctggaaatgtcaagtacagaccaaagaaagcctcaacaaaaattctgctcccttgacaaaggatcaagagatgggcagcctagcaagacagaaaattttgaaacagtaactgctctactctagccagacaccatagaaaaaactatggccccaccaccacccacattagcaaaggccaagtggggagcctggacttcacccttgccaagctgaagacccctcccctgtcacaggggtatcagagaagacaaagtaggaagctgggactttcatcctagtggggggcagtaatgagcccctctgcccggtggcatcagtggaggccacatggaaagcctagatttccatc

SEQ ID NO: 19733 - DNA, 319 bp, Homo sapiens
tggttccaagtctttgctactgtaaatagtgctgcaataaacatacatgtgcatgtatctttatagtagaatgatttctaatcctttaggtatatacccagtaatgggattgctgggtcaaatagtatttctggttctaggtccttgagaaatccccacactgtcttccacaataactgaactaatttacactcccaccaacagtgtagaagtgctcccatttctccacagctttgccagcatctgttgtttcctgacttttctttttttataagacagagtcttgccctgttgcccaggctggagtgcaatggtgcaa

SEQ ID NO: 19734 - DNA, 328 bp, Homo sapiens
cgagctggctgctgtgacgagaagccacaagtacaataccccgattgtgtccttcaggacctcaaaattgcagttcttacacaaactcagttcttgctgtgagaaaggttttctctgtgcttcttcgcctccaaaagtgagattgaatgctttccttgtgtcaggcttaatcaagcagtggaggcaataacggaagatgcaggaggattaggctcgctcaggcaatcttttccctttggggatcatacttgggcttgttctttggatttaacacagtgaatctcctcttagctgaacaatatagagacgttcattagtttggtcatga

SEQ ID NO: 19735 - DNA, 300 bp, Homo sapiens
cctgatcaatctcaaaccaaggtactcagtcaggagcaagtagcaagccaggctctgggctcctccccagactcttcatgaaggtaccacaaggtgaggaggagagaaaggtggcacgcgctggtctacccagccctgtcacacccacttagcacagatgggactgggagcccacctgtggggaccatcaaggccaacttcggggagcagctgtgacgagggcgatccctggtcccagaccctggcagtgaatctcctcttagctgaacaatatagagacgttcattagtttggtcatga

SEQ ID NO: 19736 - DNA, 413 bp, Homo sapiens
cccctctttgggttcaattaattaattgcagcagctcacagagctcatggaaacactaacttacattttctggtttattacgaatgagaatgcagaggagacagatgaagaggtgcagagggtgaagtatgggaaagaggcacagagctttcattgtcttccctgggtgcaatttcctccaggaacctccatgtgttgagctatctggaagctctccaaaccctgtcctcttgggtttttctggaggcttcattatgtaggcatgattgataaaaccattagccactggtgatcaacttaactttcagcccctctcctggaggtggggactggagttgaaagtctcaaccctttaatcctgccctggtcttcccagtgaccagccccaccctgaagctatcagacaaaagacc

SEQ ID NO: 19737 - DNA, 155 bp, Homo sapiens
ctcttctttgcctttcttccatttcagcctctttccctctcaccctcatcacttgtttctttggatcattgtcattctcttcattgttctcctgcctttcttcagtgtcacctatttgattttccttcaaatctattctctctttgacaccttat

SEQ ID NO: 19738 - DNA, 470 bp, Homo sapiens
caaaagaatagaaattataagtactgaattattctagttcatatagactgaattattacagttaaaatattatctgttccctttgtgaaaacaagcaatccctgctagccagcccggtggatgtgctcggcccactacgctcagcactgcattccggccagtgtttgtgctgtggactgtccaagggcattgttgtctactgccagaagacagggagggtgacaactgggatagagaggaccatggatgagggaaagattaatttgaaagaggggatctgagaaagtaattgtccagtaatagggaaaggaggatgctttgctagccagaagttagaattaagtgcttctcttgcctaataaataatctgttgactgtaggtgctcacagcgtctcacagaaagaggatagtgccagcacatctgggctggctggctttgatagcagtatcttcgtcctcattcacaaaa

SEQ ID NO: 19739 - DNA, 984 bp, Homo sapiens
acaaagggaagacacagtgctacaaaagcccaagagctgcaacctcctgacaggagctgggttgggcttgaaagtgtaacaagaggttaaaatagaagttctagctgaagcacaaagaaagtagaaacaacacatcaaagtgagggatttataaagcaggagactgaaaaccagctggtgactcttgaattcctcacccttattgagagtataaaaggcttatagccctcaccctttcacctcaaatcaagagggaagggttttagaaacacaacttggagagcttaatatgtatccctgaagtttgaggaaaggggacgtagtgtactgacttctgcctggaaagtctaacaggtgggagattaattgactgcaatgaaggagaaagccaatgacaggttgcttcttgactggaattgttcagcactccagaggctgtcagggaaaggatgtgagcatgctgcctggaatctgatgtggctcagctgtaggacaaagatagtgtgttttcttaagttctgaccaaatgaaccaccttaagagacaaagatcactcagcaaggaaagctgaagatgctatgagatgccagaggttggggaaggagcaaacaaccagctggaatggatatgccttttctcaaagaaaattgcaagtggaagaattccagccatggggtctccaaagcatccgtgaaactgttccacaagacaaggatggatgactgaatgccaaacccagagagcagtgaagctaaatcaactcaatcatttcagtgaagaaagaaatctcctgtcctttcctgtccctgaactccatgatgaagggccatgtgctgtaggtagcaaaacaggggagaaagaatttcagttttccttttcccttgaaattttctagctaaatcagtccgaaatgtggaaggaaaaagcatgaagttttttatttttattttttgagactgagtcttgctctgttgcccaggctgg

SEQ ID NO: 19740 - DNA, 977 bp, Homo sapiens
gctaggaaagtcaagaaataggaaggaaatcggtcagttttctatcatcattggttgggcttgaaagtgtaacaagaggttaaaatagaagttctagctgaagcacaaagaaagtagaaacaacacatcaaagtgagggatttataaagcaggagactgaaaaccagctggtgactcttgaattcctcacccttattgagagtataaaaggcttatagccctcaccctttcacctcaaatcaagagggaagggttttagaaacacaacttggagagcttaatatgtatccctgaagtttgaggaaaggggacgtagtgtactgacttctgcctggaaagtctaacaggtgggagattaattgactgcaatgaaggagaaagccaatgacaggttgcttcttgactggaattgttcagcactccagaggctgtcagggaaaggatgtgagcatgctgcctggaatctgatgtggctcagctgtaggacaaagatagtgtgttttcttaagttctgaccaaatgaaccaccttaagagacaaagatcactcagcaaggaaagctgaagatgctatgagatgccagaggttggggaaggagcaaacaaccagctggaatggatatgccttttctcaaagaaaattgcaagtggaagaattccagccatggggtctccaaagcatccgtgaaactgttccacaagacaaggatggatgactgaatgccaaacccagagagcagtgaagctaaatcaactcaatcatttcagtgaagaaagaaatctcctgtcctttcctgtccctgaactccatgatgaagggccatgtgctgtaggtagcaaaacaggggagaaagaatttcagttttccttttcccttgaaattttctagctaaatcagtccgaaatgtggaaggaaaaagcatgaagttttttatttttattttttgagactgagtcttgctctgttgcccaggctgg

SEQ ID NO: 19741 - DNA, 436 bp, Homo sapiens
tccaagacagagtcttgctctgttgcccaggctggagtgtagtggcatgatctaggctcactgtgacctccgcctcctgggttcaagcaattctcctgcttcagcctcctgagtagctgggattataggtgtatgccactatgcccagctaatttttgtatttttagtagagacagggttttaccgtgttggccaggctggtcttgaactcctgaccttgtgatccacccacctcggcctcccaaagtgctggggttacaggcatgagccaccgcgcccggcctgcagttacttttttgtgtatatttcccaatagactgtggcttttttgaaggtgggctattttaatcatctttgtgtcatcagtatgtagtacacagtgggacccagtaaacaatcagatgtgctgtttgtgtagcccagaataaagtgccag

SEQ ID NO: 19742 - DNA, 866 bp, Homo sapiens
atcggttgtctagtttttgattgtttgtgtgtatggtgtgtgctgtctctctgaccagatttcaggttcctgaggcgagcctgcagctcatactgctcatctgtcctctcctatggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccggttctgccatcacacacactagtgacattccaagtactcagtggccatgtggagctagtggccaccacacttgacaccacggatgcagaacttttccatcactgcagaaagctctgttgaacagtactgtgtccagagtgctaattatgaacagcttagaaaccacaattaatacattctcatgaggttaaaagcagacatgggaatagaacataatgcaaatgatgatgaatattttgggtgagaagagaaagctgaggacccatttctaggattctaagatgtaagatttcttaagttctttatcttagtctcatgcattctccacatcacgcgctgtaccatactgtgtagtcagaacagacagtgtgattgaaaagctttgaaaaagttaacacaaaggattatttagcacataggctgtagatacgta

SEQ ID NO: 19743 - DNA, 388 bp, Homo sapiens
attaagaaacatttatcaggccgggcgcagtggctcacgcctgtggtcccaaagcactgggattacaggtatgagccactgtgcctggttaatgtttttatttttattttaaaaatttttttgtgaagacagggtctcactatgttgcccaggctgatcttgaactcctgggctaagtgatcctcctgcgttggcctcccaagaaaaaataacaggttaaaatcagttaatatagtcatctcagttttgaaactcagtaaatgtggtttttaaaagttactttcatttctgataaatttagcctttttgaggccacaatttggccttttctctctagtgggggacaaatcctgacagctggttctttacccctgctgggttggtttct

SEQ ID NO: 19744 - DNA, 417 bp, Homo sapiens
gattttttttttttgccatgtttgcttttctatactattatttgatgattgttttctgtatattaaccttacatcaactcatatttttaaggaaactaggctttactctatataacaaagtacatgaaagcacgtgttcaaaaataaaataaatgagacaaaaacctcacaaagccaaaacctagctagatggtgttgggactgaaggtttgaaagtaaaaagagaaaaaaaaaagatttggagaggcaaataaaatgacagaaaccagtttatatcctgtaaaatcctataattataggaaattaaccaagatgagtgttccatgatattcccaattttataagcactcaaaattcagtctctgagtttggaagttaaaaaaaggcttgctttatagggcatgggaagtaaaaaaa

SEQ ID NO: 19745 - DNA, 366 bp, Homo sapiens
catccacggggctgctgactaaattttcataaaagcaaacccctattcaggcctattcaacatgggggaaccggctctctcccctgagaggagagtgagtgtgatgctgtcctaacagtgttgaaatgggtcataactggcctgtgctcagtgaagcaggcaaaagacggatgatgcacctcaacgtaaattctagccaaaaagcctaaaataactaaaaagagaccaacattgaaacaggagatcaaaaaatatcttaaggcaaatgaaaatggagccacaacataccaaaatgatgggatgcagcaaaagcaggtctaagaaggaatttaatagcaataaatgcctacatgaagaaaaaaaaaa

SEQ ID NO: 19746 - DNA, 509 bp, Homo sapiens
tacttataattcaaaaattaacctatatttacagatgcttacacagtttctttgtgaatccacctatggttttattttaattaattttttattgcaaagcaatgaaatgttgctttgtggagccagatagcattacagcaggtaaatgggtttctgctagatctccacattattggggagatgctcgaagacctcagaatatacacacccttaaggttcaagggctggggttgagctctccataaggaacttttcctcctcccagaagggcgatcattgtgtatatagacatggagacagaaccagaatgacttctgtgggtggaaatagtgccatcagaatcatttattattatgaaataaatattatttatctacattgaaaaaatactactcctcctaaaatcattaacttttcctcagatgattttaagaaatttgagtaatagcacacgaagtggtaaagacccttagtctttctggtatattagaaaagccttttaatcagtc

SEQ ID NO: 19747 - DNA, 262 bp, Homo sapiens
gggcatgagatttgggagaggccaagagtggaatgatatggtttggctctgtgtccccactcaaatctcatgtcaaattgtaataatcccgtgtcaatggagggatctgaggggagtgactggatcatgggggttgttttcctgatcctattttcatgatagcaagtgatttctcatgagatctgagatctcttgctttctctcctgtctctcctgtcttccaccatgattataagtttcctgaggcctcctcggccatgtg

SEQ ID NO: 19748 - DNA, 426 bp, Homo sapiens
catgggaagaattttgactgaaacaagactcaaagttatttaggtagcgtttacagccatgaatctcatgtgttataaagcttgtgtttttgttgatttttcttcccccatattaccaggagaatcatgactgagtatatttgttatggagatgataataaaggtcttattgtttagacaggccctaccttcagagaaagaaaaaactgttagctccttttaggattcccaatttttactataattatccattaattctagcaatcttaacaaattaggcaagaaaatctataaatggtgaatggttgagtgatatataacacttatccaagctttccatttctcattaactgattacagagttggtttgaagacatagctataaccattctctaccatgcttcatagagaccccatctctccaaa

SEQ ID NO: 19749 - DNA, 2135 bp, Homo sapiens
ttgaacagcactgaaatgattaactatggttgtcacagcataaggtgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttgattttgatgggtttttagtgggcataaatgcatgtttatttgctgcattaaatagaggagtgaaaatatgtaggtttgtaaagaaaaagtaattgcattcttctaattttgtttttccttttaattttttggggaatgaaaagatatattaaatgatttgggaatatgt

SEQ ID NO: 19750 - DNA, 2521 bp, Homo sapiens
ttaatgaagatttcagttattgcttttaagcataagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaa

SEQ ID NO: 19751 - DNA, 2501 bp, Homo sapiens
ttaatgaagatttcagttattgcttttaagcataagttgtatttagcttctgctgaaaaattgtatcatataataattttgcttcattgaaaagggatgttgcagtgatgaaacaaggtgggatcagtttgattttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaa

SEQ ID NO: 19752 - DNA, 1911 bp, Homo sapiens
ttgaacagcactgaaatgattaactatggttgtcacagcataaggtgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaa

SEQ ID NO: 19753 - DNA, 2745 bp, Homo sapiens
ttaatgaagatttcagttattgcttttaagcataagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttgattttgatgggtttttagtgggcataaatgcatgtttatttgctgcattaaatagaggagtgaaaatatgtaggtttgtaaagaaaaagtaattgcattcttctaattttgtttttccttttaattttttggggaatgaaaagatatattaaatgatttgggaatatgt

SEQ ID NO: 19754 - DNA, 2509 bp, Homo sapiens
ttaatgaagatttcagttattgcttttaagcataagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactaaaaaaccaatagagtgattttggaaggattttaggatatattttaaataaaggttgccgaggaaaaaaaaaaaa

SEQ ID NO: 19755 - DNA, 2999 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgtaaaaaaaaaattgga

SEQ ID NO: 19756 - DNA, 2524 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19757 - DNA, 807 bp, Homo sapiens
attttagaattggaactggaggagacttttccccttctgacttaaggcaccaaagtagttttaattgctctacaatccaaggaagcagaagcaagtgggtctgctgccaagaacgcttaccacaaagaggaaaaaaataattgtagctctgaattttagctctggcttgtaaaatatgacagtcttttactatctctttttctttcattgagtacctggctgccacatctggctccgcttttttttccaaatgggtttattttgttattttgaatatggctggggtgatcctggaaagactggtctgagaaacaatcttgacatttcagctagaaacaaacccagaggtagattgatctgagacagagtttgggaccatccctctgaacctctccagggttggcctaagtgtcaaactgtcattcccccctgaggaaggaagtttcacctccttcttttcaagatagcaagatgtggaggctttgctggattttccttttttacgctgccagtcgggctctgatgtggaatctgcctgtctcttctcccttgcctacaggctggaggctctcaggtcatttttaccaacccattggagatagtgaagattcgtctgcaagtagctggagagatcaccacgggacccagagtcagcgccctgaatgtgctccgggacttgggaatttttggtctgtataaggtgggtaggtttaggttataatgtactcaataaaatatgaaagaatgtggaaaccagacttcttccctccaagttgaaaagcaatcttgtccagcagggtagtctgt

SEQ ID NO: 19758 - DNA, 2412 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccagaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19759 - DNA, 2209 bp, Homo sapiens
gtttaaactacttattccagatataattgatttatttttgttttcccttttaagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19760 - DNA, 1910 bp, Homo sapiens
aagcttggcacgaggcctcgtgccaaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19761 - DNA, 2496 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19762 - DNA, 1717 bp, Homo sapiens
gtagctcatgcctataatctcagcattttgggtggtgggaggatcacttgagaccagttctaaaccagcataagcatagtaagaactcagctctaccaaaacaacaacaacaacaacaaaattaaaaattagccaagtgtggtgatttatgccaggaggctgatgtgggaggattgcttgagtccaggaatttgaggctgtagtgagctatgatcatgccactgcactccagcctgagcaacagagtgagaccctgtctcaaaaacaaaactaaaattgatgctgctgacactggcacactgtcgcagaatttgtacaactttaattttacatgtaagcatttgataattttaaattttatcataagacaaatattttgctgacttgggaaaagcaacagtatgccagaagaggaaatggttggggaattttggttaactgatgttgtctttctaattagggttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaatta

SEQ ID NO: 19763 - DNA, 1833 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgggtgttcgatctttcccagttgtgtactggcactatgactc

SEQ ID NO: 19764 - DNA, 1530 bp, Homo sapiens
ggccctgctcgctcactcgctcgtccccggcttccgagcacagcatggcggtcaaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgtaagtattactgttaggcgcttcttgtgacaaatacattccgttgacctttttgcacagatataatagatatcttagtggcatttctcttgaactcaagggattctaagcaggttttctcaataatcatatggaataagttttaaattttattgtaaaagctaacgggttttgagtgtag

SEQ ID NO: 19765 - DNA, 735 bp, Homo sapiens
gggtaagtgggaagctactgtgtatttggcctaacatggtttttaaatgctgacaatagagttatctatttttaaatacattgctttcatttttggctgcatgaatatcctattttcttcttttagaaaagatattactgcattaacaatatcacttttaggttttgttttttcttgtcttaaaatagtcaaattgtagctttttcacttgctgtgtgcgctttcaagatttttttttacccgttttcttctctgcagcagtctcctgggttaggcaggcctatctggctccagattgccgagtctgcttacagattcactctgggctcagttgctggaggtgagtgacatgtctgtgtgctgtttgaggcttgtgttaatgtaatattatctcaccagactgaggcagatcagcaaaggtgcagttcattgttcccatgggtcacgacttcagggctttctgaagtgttctttatttttacctatgatcaggagacttgtcgtagcaatggctatgaccatctggctccagtctgtcttcaggacagaacctctgtaatgatgtgaaagtctgggatgcagtgctgcactcaccttaattatactggctaaggccagtatgaaaaaatggaaaatgagactgtgtttatgggacaggttaagaaattgagattcgctattatccttagcaaactaacgcaggaacagaaaaccaaataccacatgttctcattt

SEQ ID NO: 19766 - DNA, 308 bp, Homo sapiens
ggggtgcatgtatgtgtgtgtgtgtgtgtgtgtgtgtgtgtgtgtaacttaaaactgtgtaatcatatagtgcttgggatcaggtgtcttaatattgtgtatctgtgggtctgactttgatcttggactcttacaggaaacctatataacagcccatcttaaaagtaatgttctaatgttctgacctgtgccacagtaggagatgtggagtaaataattaaaattgccatcatgaaaaacattccacagcaggaaaggaataaagaaccttccttgagaagaaaaaaaccactaaatcacacagtgag

SEQ ID NO: 19767 - DNA, 550 bp, Homo sapiens
agttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctacc

SEQ ID NO: 19768 - DNA, 368 bp, Homo sapiens
aagcaggacagatgcatatagtcctcatttcaaccacaggaattgactttaaaggtgacactgtccttagtaacacagctgatgccctgtaggggtaaaattagttgtgttttctctgtgcaggtgaaattttaatgaattttttgatactctgtagagcattcactgcaaaatgcgttgtaagctctaaacaccaacagctgattgtgaaagactctttattttttctttgccctaacttaaaaaaaaacagagaatgtttccagagaatctactaaggaaaacatcaggtctgacaacaaaagagaactgagagagcgaagaggaggcagctttctgcactttgcacactgggttgcagttctcac

SEQ ID NO: 19769 - DNA, 531 bp, Homo sapiens
ttcttgctccatacttgttagtttttcattgttcatttggttttacaggtacctagccactcagaaagagggagccttggatagtagtcactgaaaaggactactatttcaaaccctcacttcaaccgtattcctcgttgtcaaacagctttctgcattagtctcatgtgagctggggtagctgagtgtgggtctgttctgttctggggcagtgacaagatccagattcctcaacctattaatacaaaggtgaggccacaatttcatggtgtcagtgacagcaagagggagttcctggagtagcagtgccatggggccaatgccattcatgatggcatggaggctgcagtatcatgctccttggaggaggcagcagtggtatcttgcttggtcctggagtttcatgtgatttagaatgcagatgtattatctttggctgtgtattctcagaatctgggtctttagacctcttgatgaaactgagctacccattccacttacattataataagttcatttttgtctttagtg

SEQ ID NO: 19770 - DNA, 157 bp, Homo sapiens
cttgcggactggcggcgagagccctgctgactgccgggcgggaaatggggacagctaggcgagacaatagccctttaagctattctcaagccccgggtctgggcatatttggagtagagatcaaggttccacttctgaaacgggaagagccagcaat

SEQ ID NO: 19771 - DNA, 110 bp, Homo sapiens
cttacttataagtgggagctaagctatgaggatgcaaaaacatacagagcaatataatggactgtgggaattccaaggtgggaggaggtaggaaagagggtgaagcataa

SEQ ID NO: 19772 - DNA, 448 bp, Homo sapiens
tctgagcctcccaaagtcccatgaaggtgcaggcgattatttctgtgcagctatgtaaagactttcatctagggagagaatccacagcttttatctgatattctcggcctcccaagtggctgggacctcaggcgtgcgccaccatatctggctaattttttgtttattttttgtagagatatgggtctcactatgttgcccgggctggtctcaaactcctgagttcaagtgatcctcctgcctctgcctcccaaaatgttgggatcacaggtgtgaaccaccacgcctggtttatgtgtttttcaaagatgcaaatgccccaggaaggggtcagaacctcagaacttaccctgtgacttaatttcacagaaaaaagaatgaggaaatggaggtgctgagaggggaagcgtctcccagggtcacacagctcaggaccagagatggcaga

SEQ ID NO: 19773 - DNA, 547 bp, Homo sapiens
aggttgtgaataaaacattttaatttttataagaaatcatatacatttcatacattagtacaatttctattttcacagcttatctggatgtcctctcaatgcacaagttatcaaaaagggcaaggtttctgaagaactcatgaccatcaagctcaaagcaactgggggtaagagcacagggctggctgtcaccacctcctgcagggtgtagaccctggctccccaaagcgttccgtgtgtcaaagtattctctaggtgggaagcataattttaatgtacaagaagaaaggtttcctcagatttgaactaaaattataactttgtttaaaaaccaattttttggtgttttccttatttttaaataaggagtgatctccaacagagaaagtcaggcagtggggtatgatggattaagatacacttgtggttggcagggcatgctggctcacgcctgtaatcccagcactttgggagaccaaggatagaggattgcttgaggtcaggagtttgtgaccagcctgggcaacatagccagaccccatctcta

SEQ ID NO: 19774 - DNA, 6334 bp, Homo sapiens
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtgaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactcttcttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagacgatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacgaaaaaaaaaaa

SEQ ID NO: 19775 - DNA, 399 bp, Homo sapiens
  misc_feature (19)..(19): n is a, c, g, or t
  misc_feature (380)..(380): n is a, c, g, or t
ggtcgctctccggatcctngtccgctcggacgatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttggtccgagcgacnagatcctgcagagtcgacc

SEQ ID NO: 19776 - DNA, 875 bp, Homo sapiens
agcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagatggatgcagaggctgaagataaaacgctgcgtactcgctctaaaggaaccgaggtgccaatggattcactaatccaggagctcaggccagacctgaacattagaatccaagaaactgacaccttcaagaaaacccttttacctataagccactttgagagggactcaagactgatcacccaagaagctgatgataaaaattaatttagaagagaagtgtccctccagggtgtggcagaggcatctgtagggttcagccaccccggcatcggccttgtccatgcctctgtgtgatggaggggctccgtgtggaacatgaggctggaggcctcacaccaacagaagcattccagagattattttatgtttactgtactgttcttactagggcagaaaagtgtcttaaaatatattggggaagctttcaataagaataaaaacaaaaaaagactttgtaatttaacaagtaaagccgatgaactctaatg

SEQ ID NO: 19777 - DNA, 1280 bp, Homo sapiens
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtatggatgcagaggctgaagataaaacgctgcgtactcgctctaaaggaaccgaggtgccaatggattcactaatccaggagctcaggccagacctgaacattagaatccaagaaactgacaccttcaagaaaacccttttacctataagccactttgagagggactcaagactgatcacccaagaagctgatgataaaaattaatttagaagagaagtgtccctccagggtgtggcagaggcatctgtagggttcagccaccccggcatcggccttgtccatgcctctgtgtgatggaggggctccgtgtggaacatgaggctggaggcctcacaccaacagaagcattccagagattattttatgtttactgtactgttcttactagggcagaaaagtgtcttaaaatatattggggaagctttcaataagaataaaaacaaaaaaagactttgtaatttaacaagtaaagccgatgaactctaatg

SEQ ID NO: 19778 - DNA, 1052 bp, Homo sapiens
agcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatatggatgcagaggctgaagataaaacgctgcgtactcgctctaaaggaaccgaggtgccaatggattcactaatccaggagctcagaatcagtgtgcccgtggacatgaggccacttacctggtgagggacaccagagtcctttaaaggaaccaagtcattcagagaaaaaaaggccagacctgaacattagaatccaagaaactgacaccttcaagaaaacccttttacctataagccactttgagagggactcaagactgatcacccaagaagctgatgataaaaattaatttagaagagaagtgtccctccagggtgtggcagaggcatctgtagggttcagccaccccggcatcggccttgtccatgcctctgtgtgatggaggggctccgtgtggaacatgaggctggaggcctcacaccaacagaagcattccagagattattttatgtttactgtactgttcttactagggcagaaaagtgtcttaaaatatattggggaagctttcaataagaataaaaacaaaaaaagactttgtaatttaacaagtaaagccgatgaactctaatg

SEQ ID NO: 19779 - DNA, 992 bp, Homo sapiens
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaaggtgctattcacattggcttggcatttgtgtagctttgattgaaaatcaatggttttcttatgataattttcacatcatattttttttcttctttagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataataaaactccccaaacatgctaatctcgaaatgggtccctcaacatggaaggattgagttgcaagggacaaaattttacttccctgtcagagatgttttcacttcgattatccttttgatttattttattataaaagactatgtgaagtctagtattagtcatgtgcacaaatattcattatgcag

SEQ ID NO: 19780 - DNA, 1148 bp, Homo sapiens
  misc_feature (19)..(19): n is a, c, g, or t
ggtcgctctccggatcctngtccgctcggacgatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacgaaaaaaaaaaa

SEQ ID NO: 19781 - DNA, 4344 bp, Homo sapiens
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaaggtgctattcacattggcttggcatttgtgtagctttgattgaaaatcaatggttttcttatgataattttcacatcatattttttttcttctttagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtgaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacgttacacaagacgctaatcccaatggattgtaaaggtcctgtacaggcaagggtaaggttgcaactggttccattggaactccaatttattcccgagtttataacaaccccgggcggcggact

SEQ ID NO: 19782 - DNA, 896 bp, Homo sapiens
gcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataataaaactccccaaacatgctaatctcgaaatgggtccctcaacatggaaggattgagttgcaagggacaaaattttacttccctgtcagagatgttttcacttcgattatccttttgatttattttattataaaagactatgtgaagtctagtattagtcatgtgcacaaatattcattatgcag

SEQ ID NO: 19783 - DNA, 509 bp, Homo sapiens
caaagggaaattctcccataattctactctgctcaactcaattgaaattactatcctcaagggtttgtgactaaactggaattactattgtaaagcagtggataagatggaatgagaagctcagtcctatagataagttatcatgcgatttactatcccaggcaagagatcagtggggctttgaataaggcctaggaggagaccgaaaaggggcggccactgagagatatggagactatagaacaggtcagactgtggtaaagggaaggcgatagggggattctaaggggctctgaggtttctggaatggctaacagcctgaatactggtgtcattaagcatgtaggaatacggtgggaagatcatatggttaaggacatgtcaactttgaggtacccagggggatatctgtgtgaagatgtctgtaaggctgctggaaatttaaaagtggaatctaggagtgagttggaatttaggaatatagatttggaaaccacagatacatgaaa

SEQ ID NO: 19784 - DNA, 384 bp, Homo sapiens
gctggaaatttaaaagtggaatctaggagggagttggaatttaggaatacagattcggaaaccacagacacacgaattcgaaaaggggcggccactgagagatatggagactatagaacaggtcagactgtggtaaagggaaggcgatagggggattctaaggggctctgaggtttctggaatggctaacagcctgaatactggtgtcattaagcatgtaggaatacggtgggaagatcatatggttaaggacatgtcaactttgaggtacccagggggatatctgtgtgaagatgtctgtaaggctgctggaaatttaaaagtggaatctaggagtgagttggaatttaggaatatagatttggaaaccacagatacatgaaa

SEQ ID NO: 19785 - DNA, 294 bp, Homo sapiens
ctgtcatatgatctgtcactctgtgagctgtagcaaagattttgaaatcaagaaagagaaatctttgagctcctgaatgtggaacaacttaatgggagggaagaagaaaaattgggggctttgaaaggagaacagcgtgagaaaaattatgagtgcaggaaggtgtaagacaaatgaacaggggaatgagtgttcagtgtagcaggtgtgatgatctgttaccacaatatctcacactatgaccaaggattaacaaaaagtataagtagatggaaccatgatatataattatat

SEQ ID NO: 19786 - DNA, 269 bp, Homo sapiens
gggaaccaggtcggagcctgcttgcagagaatgtagcatcgtggcagagaggaaaaggaactaagggaagcggaagtatcagtaaggagcctccgacagaaatggtaggctggcaacatcctgatcagcagcagaagtgattttcccgtgtccccgtgtccctgctcaccacccacgctcccgagagctcccaggccaggcctcacagggctccttccctgtgggagcggaggtttgccgcgagccatcgcccggcacgggacacgtct

SEQ ID NO: 19787 - DNA, 472 bp, Homo sapiens
tcctaactagagctgtgccttagtttgctcaactatagaatcggaaaaatgacgcattcttcttagagttacctctcagattgtgcttctgatgcatgtcaagcccagtgggggcacaccgttagtaatgagacatcttagcaccaatatgtgcttttcacattgggcaggtgtcaggagaggcctggggtcataggaccagactgcaaacaacacaatcccagaataaatcctattaatttggcataattgatgaaaatgaagattagatatttgaccagagatgagaaattcatgggcatgaatgctgcagctctgattactttgcatgtgaatgtgtggtaagaggcaacatttcttttgtttaaaaccctgtgcacctaattcacattcagagaaaggttgtagaatcattcaggctcattgaaaacaaggaaccaggatgccagccgagccctatgcagtctcagaa

SEQ ID NO: 19788 - DNA, 1001 bp, Homo sapiens
gagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctcccctttaaaaaaaaa

SEQ ID NO: 19789 - DNA, 502 bp, Homo sapiens
ctgacagtgctgaaagtgaagactgagattcaggagctgaggtgcccctgtgatccaggtcttccaccctgaaaccccatcctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccagggaagatgggctgccagcaactgcagaggatgcagccacctgcttaactgtgctgtccagccagccagccagctgcagggcctcttgctgcttaaggagctgatgggccgggcatgtttggctcacacctgtgagcacagtactgagaaatgggagcacagtactgggaacttgggagcacagtactgggaaatgggagcacagtacctggga

SEQ ID NO: 19790 - DNA, 208 bp, Homo sapiens
atgacttaaactttagtaaatattcaggagacaaaattgtatattcagttttttgttgctatgtaaaaattgggaaattgattggatggacacgcaccaaatcttaaaaatgattatatctggaagtaaaattatgaatgatttttttttcttgtagttttccatgttacattttttacaataaatatatattattttttaatcagaa

SEQ ID NO: 19791 - DNA, 1072 bp, Homo sapiens
ggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaag

SEQ ID NO: 19792 - DNA, 888 bp, Homo sapiens
ggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaag

SEQ ID NO: 19793 - DNA, 444 bp, Homo sapiens
tttccataccaatgttttcatgcttcctttgtattttatcttttagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccag

SEQ ID NO: 19794 - DNA, 185 bp, Homo sapiens
agagctgacactttagggctgtttgttactgcagaacagcttagctatcctgactggtgaaataagaaaccacactctaaagtcgaagttgtctaagcatggaaaggactacttgaggaagtgttaggttccatggactggaagtactcgatatagctatactaccagtttggaggatgttaaag

SEQ ID NO: 19795 - DNA, 458 bp, Homo sapiens
tcccttgtggcctagaccttggggccacatggagacaagaaacaaagtctagagacccaacaatgagggaaattagattggaaactcccacataaaaccaggaccactgaaagatcacattctcagcgagtgaaccaggaaaaacccatcccgcagggcaatatagggatacttaccagtgttggccttggttctcgggggagggaaagacagtgtcttctttaagagccataagcccaatctcacaagagtttggagttggaattcacattatctgtgtgacttgaaaaacagaatacttataatttagttcaaagctgttctaagttgttggtgttcccagacacatgacagaagcaaacacagttcttctctgacaaaatgaactttaagcctggaacactaagaattcctaccaatgaagatccaaagggtagtcttagccagagcaatcaggc

SEQ ID NO: 19796 - DNA, 623 bp, Homo sapiens
gtgaaaagcttgaattctaaggcagatttacatcactttctcatgattcaggcttatatatactgcaccaagcagttctgtgactgtgttttattgtatttgatataaccatctaaaaattggcacttttaataatatactcagacaataatgtggcttaaaacttaaactaattggctgctctgtaggccagtctagtttttgaaaggtttgagatgtaatttctgaaaaaattgctgtgggaagagaaagcctatttgccaccccaacctgagttcttgctgggtgggaaggagggctcctcccctctccttgcctgctccaagttaggtagaacaacatgactggacacaggctctagctggtgggaactagcaagtttcagcaaaatatgaaatgggtgacctttgagaaatgtaaggaagttaaagaattgaggtgtacattcttttccaagaattcttggtatgttaaatggttttacttaacaaacagctttgtagactatttggaaagtttggaaaaatagaatgataaaaaatctcaatttcactacttactattattattattattttggagacagagtctcactccagcctgagtgacagtgagactcctca

SEQ ID NO: 19797 - DNA, 1748 bp, Homo sapiens
tatctgttccagagactttaacttgactttgcttcattcacaaagaacagagttcaagaagcagtgcatcctgtgagaagtgtgaagtgtttgtacatcactttaaatatattacttaatatattctaagttgctgtgtggagcagtatactgttgttttaaaaatgcaagattcagacaaattttaatattgtctcattaaaataatttaaataatggtataaaatatctatatcattaaaataattttccatagtgtttagaaaccatgaaaaagaaaacatagcaggagaaaatatgacaggaaaagaaaacctaacaaagcccagaacccacagttaaccaaactagactgactttgttattacccattctttgttagtattggatagggaattaggataatgagccattaggcagttctgaaatggaaagccctgaaatttagtgcaatgtaactttaaaactgaaattatataaagagtagaagtttaatcatgtttaattacaaccaaaagcctgttgcctttttgtacagaaatctccttaatttcaggacatgtagatagcttatagaaacatccttttaaatagtttgtgagctcttcctcttcagtggaattgaggaatacagaatgctttatttcatcatcccctgacaggtgacttaggctttgcacagcagatttatttttctctgcgttttttaaaaattgtttttcttgtatcttttttcttcaaaaatatctatatttgagaatatgtacataacaactttccaaagtctctgtggccaaaacctctccagggataagactgagcaagaatataatacttcaaaaaatgtacagctactgtttaagttttaaacagacaccatcacagtttgtggatgaaatagttttaagccatatactttctgtctttttttccccatattaatattggggggcggataatatcactttgatgtacattgatattaaagtttggtaatgcagcttttactgtctacatggtactgtacattagtttttaagcagaaacacaagaaaaatgggtataatttcaaagtagttcttggcagatggctagagaatactgcaagtgaccctgtatcccgaatacacagatatccctctattacaagtttgggattagccataattctgacatggtgtgttcaggtatgggtatatgttgtcagtctacacttgtggaagcaaatatcttgtttaatcaagatgatgtctagtgtcacctaaataatgcaaaaagtttaattctggatgaattcagctttactcaagatccacatattcaagtatcattccacagatattcacagaacacagaaatatctgtgttctgccttatgcctgtggctaagggatgcaaagtagaattgctttacattgactatatatgtgacatgtacgttgctgttttttttaaaataactttatcatgatattcaggtagatcctgggttctagaatatttaaaacaaaaggataaaatgataaaccaaagagtcaacttgttaacttttcttttttaagagatgggttttcactagtatgcccagtctggactccaagtcctgggctcaaacgatcctccagcctcaggttcctgagtagctcaacattttatgtatgtacgatattataaagaaatattcttccaaatgaacttttgtttttagatcaataaatgaataataaataattttgtacaaacatcaa

SEQ ID NO: 19798 - DNA, 1590 bp, Homo sapiens
  misc_feature (687)..(687): n is a, c, g, or t
ttttttttttttaacttgaattgatagttggtttataatcctggagttgtatatgttagggtttgctattgagaagtataggagtgtattaactctgataaatgaagtgggctaattagtatttcagtttaattttctgcaattgcatttaagtttgtgatcagttcttttctcctcactgtataactttttcctgaagatttgtataattattagtggtaaaaactccatcttagttgcttatgattttaatgtcaatttgaggaagatatcaccatatagaaaatacttagaagtagcttattttaaaaatattcatttgcttttcttccaaacacgtggtcacttagcaagcagtgattcaattattcatagtcctcagtatttatgtaatgccaaagaagtggaagaaggggaagtgaagtgagaaaggaaattaggcagacaagtgaatcagagggcaagagaaatgagtaatgcaaaaggggaaggaaatgatggtcagagcacacatgccttgcagcatgagcaaagaaaatgtgctaaacaaaactacagtcagaatcatagaaaggataaggttttagagaggttttgttgttttttaaacattcatgtgagctaaatataatgcaggtattgaaatgattactgcagatatgccagatgaccttgatatctattttnatgttaatcttctgttatttgttgttgttgaattgttacccccacgttttacctgtgtaagtgaattgaaatatttcaaggccagatacagtgtcttacgcatgtaatttcagcagtttggaaggatgatcacacgaacggatggatcacttgagcccaagagttccagacaagcctgggcaacatagtgagaccccatctctctaaaaataaaaaaaaaattagccgagcatgctgatgtacacctgtggtcccaactactttggagactgaggtcagaggatcccaggaggtcaaggctgcagtaagccctgatcacgccactgcactccagcctgggcaacagagtgagaccttgcctcaataaaaacaagacaaacaaaaaaccagacatttcaataatacatgcatggtgctgtgttacaagttgtaacatgaataaaaatgtttaggatatcttaaatataaaaaatcaagaaatatcttcttttggggggaaggggtttttgtaatgagtcaattaaaatgttggtgctaaatcttcccttgctatattgaagtttgctgatttcaatatagattttcagtgtttcataatgccttttaaaaaagataattgaggtggccaggcgcagtggctcacgcctgtaatcccaacactttgggagaccaaggtgggtggatcacgaggtcaggaaatagagaccatcctggctaacatggtgaaacccaactctactaaaaatacaaaaaattagccgggcgtggtggtgggcacctgtagtcccagctacttgggaggctgaggcaggagaatggtgtgaacccaggaggcagagcttgcagtgagctgagactgcgccactgcactctggcctgggcgacagagcaagactccatctc

SEQ ID NO: 19799 - DNA, 346 bp, Homo sapiens
ttaatttgtactaaatctctagattatttatataaacagaagataaagattgagtgaatagtgaaaatgggtaaatcagcctttatgtgtcattctgacatattctacttgtatatattaagatagaattataaataaataaattataattattgtattactctttataaaaatattcttatagaaggtttacagaaatacaacaaacatcaggtattcactatatagaattgatgaatgttaatacatatatatcatatacactttgcatatatatgtgtttatgtgtatagacgtagacatatatactttaaaacccttttttaagaagcaacaataatacatc

SEQ ID NO: 19800 - DNA, 394 bp, Homo sapiens
cgtcagtcgccactgcgtgtttcctacattctctctctctccacgatgctgcaggggtgttgataaaccctgtgtttaccttcggatcatgccatcttcacaatcccagctactccacgagataagcatggcgggttgtggttgtctcacggtcttctctcttgataaaagcctgagagaggtgggtgtagtaggagatggttatctcttggcttggggtgcgttttctgttcatccgtgcaccttacctcacctcttcaaaggcaggaaggtgtggaagagagaggcacatggcagagggggtggctgagagtggcaggatgggtggaggagaccgacacttcagctcagagtctgcaggctctgctctggaggggaagctagacccaacgtg

SEQ ID NO: 19801 - DNA, 1195 bp, Homo sapiens
acccttgaaatttcctgagtggtaagagtaattaggatgacaagcccctttaaccacacctgagtttatgttaatgggattacttttggaaagacagaaccacaggatgggggctagttgcctcgagaaccaaccatgtgattagagggtggaactttcagatcaaccccaccttaccttgacctctgagaggagagaggctggagactgaattcagtcaccagtggccagtgatttaatcattcatgcctacgtgatgtagccttcataaaaaactgaaggacaggattcagagagcttccaggttgaacttgttgaggtactaggagggtggtgtacctagggagggcatggaagctcagtgttcttcccacacaccttgccttatgcatctctttcatctggctgatccttagttgtgttcttttacaagaatctagtaaataaacttttcctacattctatgagtcattctagctaatgctgaaactcaaagaggggattgtaggaaccttggatttatagccagttggtcagaagcaccagtgaaaacatggacatgagattggtgtccaaaactgacacaattggtgtcagttgtagaactgagcccttaacctgaagcatctatgttgatctgattccaggtagatagcttcaaaatttaattacaggcacttagtgggtgtccacagaaaattggagaattgtttggtttggggaaacctcatacacatctggtgtcagaaatgttgtgagtatagagaagacaataagtttttcctatacagtagctaaagtacctacatcattaatttgtatagtatattctgtgtaaaaataagactttctgatatttttttcaagtggcaacatttatcagacttttttgatttctgacatacatactgaaaacaggcaacatacatgcaaagttttccactgaaaaatagaaatagtttgaaaaaataaaaaattcaaattgtctttctggtattaacaatttgataagttctgctactaaaagtactacaaagttgtttcctttgattatcccctataattgtctaattaatattttaatttagcagacattgttaaattctattccttaggagtgtaatgctaaggcaaggccttttgggaggttttgtagtacattaaaagaatatactatctcttccaaaaaaaaaaa

SEQ ID NO: 19802 - DNA, 870 bp, Homo sapiens
aggtgatctagaggatcccgtcaattctacacctcagtgttcttcccacacaccttgccttatgcatctctttcatctggctgatccttagttgtgttcttttacaagaatctagtaaataaacttttcctacattctatgagtcattctagctaatgctgaaactcaaagaggggattgtaggaaccttggatttatagccagttggtcagaagcaccagtgaaaacatggacatgagattggtgtccaaaactgacacaattggtgtcagttgtagaactgagcccttaacctgaagcatctatgttgatctgattccaggtagatagcttcaaaatttaattacaggcacttagtgggtgtccacagaaaattggagaattgtttggtttggggaaacctcatacacatctggtgtcagaaatgttgtgagtatagagaagacaataagtttttcctatacagtagctaaagtacctacatcattaatttgtatagtatattctgtgtaaaaataagactttctgatatttttttcaagtggcaacatttatcagacttttttgatttctgacatacatactgaaaacaggcaacatacatgcaaagttttccactgaaaaatagaaatagtttgaaaaaataaaaaattcaaattgtctttctggtattaacaatttgataagttctgctactaaaagtactacaaagttgtttcctttgattatcccctataattgtctaattaatattttaatttagcagacattgttaaattctattccttaggagtgtaatgctaaggcaaggccttttgggaggttttgtagtacattaaaagaatatactatctcttccaaaaaaaaaaa

SEQ ID NO: 19803 - DNA, 514 bp, Homo sapiens
accacaattaacttttttagaggtcatgtcataaacagatcatctttcattttaaaaagctatactaagccaggcatggtggtttacgcctataatcccagcactctgggaggccaaggcaggcagattgcttgaggttgggagttcaagaccagtctagccaacatggtgaaaccccatctctacaaaatatacaaaacttggccgggtatggtggtgcactccggtagtcccagctactcaggagtgtgaggcaggagaatcacttgaacccaggaggtggaggttgcaatgagccgagatcacatcactgtgatgagatggagtgagactccatctccaaataaataaataaataaataaataaataagccatactagttaactttttgggggggcaaactttaggaagtgtctttaatttttttaattaatttattttagattcagagggtacatgtgtatgtttgttacactggtatactgtgtaatggtggggactggacttatacac

SEQ ID NO: 19804 - DNA, 1086 bp, Homo sapiens
aggtaggtagataaatagatagatgatagatagatagatagatagatagatagataagatagattttcctactggcatgtttcaccattttcttgactcacatattctggtttccatctggctccttcggtctgtgctctcctcactgaagtaaggcctttaatgattacttcattataagtccatgagtaatatggtttggctacgtccccaaccaaatctcatcttgaattgtagttcccataatccccacgtgttgtgggagggacctggtgagaggtaattgaatcatggggttggtttcctccatgctattctcatgatactgagtaagttctcatgagatctgatggttttataagaggtgtcccccttcacttggctctcatttttctccttcctgctgccatatgaagaaggatgtgtttgcttccccttccaccacgactgtaagtttcctgaggcctcgccagccatgctaaactgtgagtcaattaaatctctttcctctataaattactcagtctcaggtatatcttcatagcagtgtgagaatggactaatactttgggtattacactttttagattttacgtatttgaaaaagcacttgctttttatacctgaataaagtttatttgttcacagaaaaaaaaaagagcttcaactcaagatgctttttatactcagccttaattccccttcacttcctattaaactaagcacagagcagaatctgggtatctttgctgttgcctcttctgccttcaaacatgatttaccacccacagacttgcctatgctgtcaaatcttttttaaaaaaatacattatctctaataatgttaagtgcatttttctttactcccagttggcatcacttacatgattgtggcctgaagaccatcgtctcactttcgtaggatagttagacagtttttcaatagcaccgatcctttctacattaaaagttaagtggaaagtttaggttctcagcggttcaaatgctctctctcattactatttacaggattaaacacgtgcataattttctaaaattctatttcaaataaatagcataaaaacc

SEQ ID NO: 19805 - DNA, 430 bp, Homo sapiens
attgtttccgtgcaaagtgacaaacgaggtaacatgaaccttccaaagccaactgggttgtctttgtctttccgtgccaggtaagaagaagaggacaagccctgcccagtcccaagaagtgttaacaggcgctggagctttatctgcggctgcactcgcttctccctcctgcagacattcttgctgctttccggtcccacgggacggctcccaggctcccgcctcacggcaagaaaaataaaggcctccccgcacagccagccagcttcgttcattcacgtcaccgacaaacactcctagcaggcgttgttaaacgttcagggagcgcccgggacctagccgaggccccctcctggctgtgccgcggggggatgcgcagcccctcgcaccgactgcgggaaggagagtgtgggtggccggcgcgcccggt

SEQ ID NO: 19806 - DNA, 366 bp, Homo sapiens
tttatgtattgtgagctgttgtcagggctaactgggtgccattgtggctgaagatgttgcgcaaattgaggcagatggctcagattcagacacgtgtcatatagaaaggggcaaggggattggccctgcaaagtggggtcacagcaggtcacagacctgctctacacttgttagtgttttcaaaagctcatgtgcagcaactttgtttttctccagtcatccctgcaatcaaaccccctcccccaaaaagtgtgtggaacatgcttcatgtggaaaagggaggcttgggaggttcctgtcctcttccttcatgaccctgaggctcaactgtgcatgcagaatgaattagcaggattgacagaagtt

SEQ ID NO: 19807 - DNA, 394 bp, Homo sapiens
tgaaaatccaggaccccagcatagtataaaatggaccaatggtgaattgaaaccaattaaatagagctgaggcatcctgagcaagagcacaagctctgggagctgcaaatgagcctcacccctgccacttactaattgtgggactgtgcgagagttatttaacctttctgaacttcactgaacaggtgtgatttctgtgaggattaaatagaaaatgtaggtaaagtgcccaaaattacaactcttatcaactttattagtattatttataaaaataactatgttaactatagttacaaaataaaaattagaatttagttttaaaaataatattttgagaaataacaatataagaaattgcctatataatacaagactaaattggtaatgacaa

SEQ ID NO: 19808 - DNA, 279 bp, Homo sapiens
gttccgctgggtactgagatcagactgaaatcccgatcactggtcgcgacccccgccacttgactttctatcctctctccacttgagagtcgtgaatgtctttttcggttcctcggggagtgagttctgcattgacttttacacccggagtttttcatgcgcgacatattcctccctgctcccccgccccattcaccatctcagtatcagctgggttggttaatacgatggctattacatgtaagataacccgtgcatgcattgtgagcgatatcggat

SEQ ID NO: 19809 - DNA, 233 bp, Homo sapiens
ggagagagagggaatgagggaagctttgccagacacctccaacctatgctggagggaacacaaaagctggaaatcaactctcacctttgttgtccccagtcccgttccctcttctggtgcatccagatgggagaaggcaaaagccaagtattctaaccaggaaatcacagggtagtgccttacatgaagttaagaggaccagttttccaagctgcctttagagaaaagagtca

SEQ ID NO: 19810 - DNA, 336 bp, Homo sapiens
atagtaaacgcagggtagataaacatgggtaattacagagaaatagtcatagccattgatgataatggaaatgacagtagtgccaggcgcctttggtggtttctggcctggtggcaggcaggtggctcagcagcaactgggaaggtgcgcaggtgagcacagtctccctttgcaggtggcttctggctctcagccctgtagcttcgactagcttcgactctgtggcacaaccagtggatcacttgtggtcctgcgagcgcagacagcagctgccagcatgggaacacggagggcatcagttcatcacttgtggtcctgcgagcgcagacggcagct

SEQ ID NO: 19811 - DNA, 437 bp, Homo sapiens
catatggaagacaaagtggattaagagagaggactggcattgggtttgcccaatcctctgcagtttagccttagacatgagggccgaaccctaagcaaagtctggtaattgattatggtgttttaaaaggtattaatctttaggatgaagtccaaacaggatgaaaatttctacaaatgtttgtttcctatgtcatgtgtgagaaaaaaaaatgtgagtgttgcagcacattttgtttgcttagtttggcatcttcaatcaatttctcaattatttaggttgaaaatagcttttaataaatatttggaaggaaaaaactcccccttgggatggggggaagcaaaccccctctctaattttggtgaataagaattgctttcttagctctcagagtttttaggaacattgaaataattcatagccatcagtttagaaaa

SEQ ID NO: 19812 - DNA, 84 bp, Homo sapiens
tctaccctcacaattccaccaaaactagtatcacaaccatcacgttgtgatggtatcccgagcatccacattgctcagttgaat

SEQ ID NO: 19813 - DNA, 450 bp, Homo sapiens
gttgggaggctgcgtcgacgggagaaagagaaattattgaactcccattccgtatatgacattatagtcagcattcttggggaaacagagatgactaagtaagattattgccttctaggaggttatagtctagcaggaggactgtgaaccctcccagcctgccgctcgctagctggagtgccctgatgtcaggtggaaggcaggagggactggaagaagggggtccagaaggaggccctaacagtggtgtgggagaaacctgctgctttggggtcggcgctcagatggtggtggaatgtgaaggagaagtaggaggtgtaagattattgacagttcttgtcacctgactgttaagaatagtgagagaaggccaggtgcagtggctcacacccgtaatcccagcactttgggaggccgaggcaggcagattacttgagcccagaagttcaa

SEQ ID NO: 19814 - DNA, 436 bp, Homo sapiens
aggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaa

SEQ ID NO: 19815 - DNA, 434 bp, Homo sapiens
accttacaagagtccttcataaactcactgagaaaatgattgtcatgtgccaggcaatcatttgttcatccttttaatgaaaccatttgttgaacatctacactttccagtgcactgcgcttaggatatccggggagaaacagcagcaatccctgctctctaggaggccatagtctcatggaagaaataagtaagcagataattataacaagggacaccaaattgaaacaggttgtagtagagttggcattgagttgagtcttaaaaggaatcaggcatattgcaccagataaaaagcaagaaaagcatgaagaaaagagttccaagcacagagagaagcatgtgttaaggcacagacagatgaaagcatgtcacatgcatgagctgcaggcactctggcatgggtggaacatggagtgtgaggaagccagtgt

SEQ ID NO: 19816 - DNA, 391 bp, Homo sapiens
ctcggtattattgctatggaagatgagggtcatcgattttggtgggaaagtagcagcctctccctcagagggagtaacaattgtctacctagcagaagaacaccagcccaatccacactaaacggagatgtaaagaatatgcttccaaatgtggagatgatcaaataacatatcaatgatattttcttggaagaaaagtctgtaaaaattctttggggctttctactttcaaactgaattatgaacgattctcataatttctgtctctttcactagagatgagagaaggaaatatgacctttttctagtcaccaaaacatctacatatttacttattccatgagaacaaagttggcagaataacaatgtgatcacagaataaattaacctc

SEQ ID NO: 19817 - DNA, 464 bp, Homo sapiens
tgacagcaacctcgaattgacttcagttgccaagagcattgggcacttcccccacaaggtgaaaagatcatcctgtgtccactgctctgtggcttggcatgcctcgatgctggcttctcagacaggccctgcacgggtggctcttcttgccaactttaccccattctctgaagggcactgggagatggaggggaagaggttggtgcttgaaaaagaaaagattgggaggccagatgtgcaccccaaaataggacttcccaggaaatgggtctcagtgagcatattaacatccagcatcttcatctactccatgctcacctaagacctctggggtcaggggaaggggctatggagtcagtgggaagtgggccagtagcagacaggagagttgcctggcataggcagtaggtgtgaatgcaagctgtgatatttcagcagagacctggaattcagtcataaacaga

SEQ ID NO: 19818 - DNA, 581 bp, Homo sapiens
gtggaggctgcagtgagctgtgatcgcgccactgcactccagcctgggtgacagagcgagactctgtctccaataaatagataaataaataaatggctctgaaagctgaaaaccagctttgtgccagaatactttaaaatatgctgatttttttcagaaaatgggacatatttacagtaggaaaaagtttaaaacagagggtcagacagaggaggcttcgtggtggaggtgacttctgcactgagacctgagggacagagttaactgagaccagagagaaggacattctagtccaagttggagcatgtgttgaggccccatatccagattcaggccccatatccagattctgaggcttatttggggaacaaagagtcatttctcacaatagctgcactctggagtgaagtgtctggagaactcagcagtatccatgtcatgaaggtgatgaaggctacaaatatgttttgagcatgagagggacagggtcagatggtgttaggatgactcctctggaaccctgtgtaggacagatctgcggcgagggatccagggacgaggccagtgcagcagcagcctgg

SEQ ID NO: 19819 - DNA, 705 bp, Homo sapiens
gcacctcccaccccctcccactctcttgcttctgcttttgcctttgccatgtgagaggacttctccccttgctgtgattgtaagcttcctaaggcctccccagaagctgcgcaggtggcagcaccatgcttcctgcacagcctgccaaatcgtaagccaattaaacactcttttctttataaattactcagcctcagataattctttatagcaacacaagaacaggttagtgcaggctctgtgtttattacagcagttacataaatgtttttgtagtgaaactaaaaaactacctgttggctactgtgcttattaactgggtgacaaaataatctgtacgccaaactgccacgacacacaatttacctagataacaaacctgcacatggactcctgaacctaacataaaagttttttgaaaaagtaaataagatattaaaaaaagaaaacaaaagagaatggcaattccatattaaaaacctgcataatttaggctgggcacggtggctcacatctgtaatcccagcactttgggaggccaaggtgggtgggtcacgtgaggccaggagttctagaccaccctggccaacaagacaaaaccctgtctctactaaaaatacaaaaattagctgggcgtggtggcacatgcctgtaatcccagtttctcgggaggctgaggcacgagaattgcctgaacctgggtgg

SEQ ID NO: 19820 - DNA, 798 bp, Homo sapiens
gcgtatcacatggtgagagcaggagcaagagagagaggaggggggtgctacacttcttcaaacaatcagatctcatgtgaattcagagtgagaactcactcattaccatgaggatagacccgcccctatgcaccaaacacctcccaccaggccccacctccaacattgggagttagatttcaacatgagatttggaggggacaaatgtccaaactgtatcagaaaggtaataacagagttcaaatgaagaagaaattacttcaggaaaggcaatcacatgatgaattgtagcagttagaacttgatgagatgcaagtgacagaaaatacaatcaaacaggtaaaaaaaaaaaaaaaaggaatttattgattcatataacagtaaagaccaggggtagaactagcttggggtgcgaatagttttagggcttaaacaatgttatcagggctttgctctgccttctgctcacgctgatattactcttaggctcttcctagtatctcctagtacttctaggtgaacatcacaacaccaagttccgaagaaaagaaagtctggtatcacaaagtcttggaattgagacttgtcttgactttcctcatataggtcattgtatctgtgaacattattgctctggggaatagaatgtgctgatgagcttagctttgtacatgtgctccatctgtttcacagatgttgattttgtgattgttattaattaaggtattcatttttgttttgtgaacttgtccatatatttgttatattttgcaataaagttttttttaaaaaagctaa

SEQ ID NO: 19821 - DNA, 201 bp, Homo sapiens
cacagcggctgtgcaccaactctttattttaataaaccttctaccatgtagaagtgaaataaatgatcgtatttagtaattatcatttttttctctacaatttaccttatctaaaaaggtaggattttccattttatttcccatttttgatgtgactttgcctaattttgtaatagatgattttaaaaatatgttttgtca

SEQ ID NO: 19822 - DNA, 660 bp, Homo sapiens
ctagcactttgggaggctaaggtaggaagatcgcttgaactcaggaattcaagccaacctgggcaacatagcaagacctcacctccactaaagggaaaaaacaatccatgttccttttcttccaacccaacagatctgtggctgggcagcagctgctgagctcaactacaattccagcctgctttacagttaggcttgtccacaggaccaagttctcagtgacagagtaagagcaggcctgtgataggagcctcttctgtacctcggcctccaagctgcctagaatctggctgtggcagtgcccaaggggaggcgagcagcaggagagaagggtcctggggtttggggggaccaggaggagcagagctgctgctcagctcagatccataacctgagaaagaaagagggatggcacattttatgtgttaacttaaatatctggctacatcgctcagatatttgattagacactattctagatgtttttatgaaggtattgattaattgattgattgattgagacagtctcactctgttgccccactgcattgcagcctgggtgtcagagtgagactctgtctcaataaataaatttaaaaaattaaatacatatgaatacataaaaattaaatgcataaatacataaaaataaaaaaatac

SEQ ID NO: 19823 - DNA, 1574 bp, Homo sapiens
  misc_feature (1284)..(1284): n is a, c, g, or t
  misc_feature (1332)..(1332): n is a, c, g, or t
agtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggcaacaagcaacgttgnatcatgtatctcttaagtattaaaagttttattttctaaagttaatcntgttttcaaatattttcaaggtggctggttccattttaaaaatcatcttttatatgtgtctcgggttctagacttcaggctttggggaaattgggtaattagaattcaaaaatctctgcattcctgaaggtggatatacttcatatttggtaatcaagtgaaagagttgtgctttataaagtcagtttggaataagttggaacaattctttatttatgcccaaaagcaatggtatatatagg

SEQ ID NO: 19824 - DNA, 892 bp, Homo sapiens
  misc_feature (826)..(826): n is a, c, g, or t
  misc_feature (828)..(828): n is a, c, g, or t
agtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctggcctctcgtcggcctccttcncnttgaggatttccaatgtcatctccacgtcgagcggccgcgaacttagtagtagtaggcggctgc

SEQ ID NO: 19825 - DNA, 447 bp, Homo sapiens
cgaacccaacatgaaccccaagctggacttaccaaagtgagaggccttctttgttctcccactccccaaacacctgcaggctgagagccccccttcccattggcttaatgggatggattagcttttgtggtcctcctaatctggtatttaatagtggtgggtgggggtggagaggttggtgatctggcttcattttaagaattctcctttccaggaaaccaaagttcagcatcttaggaagctgtcataggttaaagagcctttctcagtcaacgaaggggaacagtatcttttcttgaccttattaatgtgattctttattcctgaaactgtgttatgctctggaataaaatatgcatccctcctgagttgggtaggtgatactgtttctttgcaatgcagtcgaccagaaacctccttcctctggttcaccaacccatgcaagac

SEQ ID NO: 19826 - DNA, 583 bp, Homo sapiens
ctctgctcagggcagctcagaactaaaaggaaaacatttcacatccaagggccttgagttgagtggaaattgtgtctgtagatatttcattactttgagtttaaagaactctgtttatgctcatatctttgagaaagaaaacaggagatgctgtgcagtggacggctatttcttcggccattttccttcctaactggaaagactttaaatgtccaccaggctccctttctctaactcaccatttacctgttcaaaatcactgtgtgcctctctcctgacaagaacgttctgttcacttgtgaacaacagctgatccacttgaagctcatttggacttactgttgtttccttggctaggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgtatgaacatttcctggttctggttgaaaatcgtt

SEQ ID NO: 19827 - DNA, 1614 bp, Homo sapiens
gcaacctccgcctcctgggatcaagcaattctcctgcctcagcctcccaagtagctgggattacaggcatgtgccaccatacccagctaattttgtatttttagtagagacggggtttctccatgttggtcaggctggtttcgaactcccgacttcaggtgatccacccgcctcagcctcccaaagtgctgggattacaggtgtgagccactgcacccagctaatttttgtactttttatttttttttttttttttttttttgcgacggagtctagctctgtcgcccaggctggagtgcagtggcgtgatcttggctcactgcaacctccgcctcccctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19828 - DNA, 2546 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19829 - DNA, 1388 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatat

SEQ ID NO: 19830 - DNA, 2751 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgtaatcactctgccccttcgcccggcctgtcgctgaccctctgtcccgccgcctcggagcactccgaaaagcccctgaccgccggccacgagtcaagctgccctacccgaggcactctccaaggggagagaaactcctaggccagcgactcaccctgcccgcagccaggacgtgaggcccctaagctgcccgtttgattttctcagggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19831 - DNA, 1006 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtattttgaaagtgctgaatcctaaccactagagatcatgtcctt

SEQ ID NO: 19832 - DNA, 1593 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgtaatcactctgccccttcgcccggcctgtcgctgaccctctgtcccgccgcctcggagcactccgaaaagcccctgaccgccggccacgagtcaagctgccctacccgaggcactctccaaggggagagaaactcctaggccagcgactcaccctgcccgcagccaggacgtgaggcccctaagctgcccgtttgattttctcagggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatat

SEQ ID NO: 19833 - DNA, 2557 bp, Homo sapiens
gctaccctcgacggttacttgtggtgctgcccgatatgagcgccccatttcggaaacccgccttcgtgaaagatctgcgtgctcgtttccatcacattgtctgccattcctgtgcgagtggtcatgcaccagactcccgcgcgatgtcgtcagaatgcaagacattccacgcacatgcggccatcctgcgtgttgtaccatcgacacactggttcctcatgactctccaggtgcccaacacaactagctgcaatgactttctcatgaaaaatgccctcgatccatgggagtcttccttccaggtgtagactttcgcgccttcggtaagcgatacttaccctgaatctggccacccgtagtcaaaccatcggtccatcttctctggacgcgattgggttccttggaagcactcactacgtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19834 - DNA, 2265 bp, Homo sapiens
acagatgtgttcctggtgtggagaaagtgccagggtggctcagcgaagaaaaaagaattcttgtggtgctatcaagcaaggcttcatttgagggaaaagtaggatttctgtaggtggaaaaagagaagacattgatttgaaactccctggttgttttataaacttcatattagctatgtccacagagcctccaaaaggatataattcaaaagggattttaaccaaaatgaaatatgttgtgactaatagatacagtttatttgaatgaatgatagtttttcccatttgatattttaactgtgctacacaagaatgagagtagacatagctcgatttgtagtctcattgttctgtcttttctgcccatttcagtgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19835 - DNA, 1944 bp, Homo sapiens
gcacctgcttctgaggtcgatcttagaggatccccatttttacaagaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19836 - DNA, 1001 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccaggtgagtacaatgggaaattacctattggtaatttccactgattaaagggaaaaggttctcctaaaaatcaaggtctctggctgtgttcttatacagtctgtgttcttacggtctaaaagtaaaagatttactgataacgagcataccttgttttattgcagttcactttatcacactgtatagatgtcgtatctgttcatatattgaaagtttgtggcaacccctgtctctactaaaaatacaaaaaaattacctgggcaacatggggagattttgcctcaagaaaa

SEQ ID NO: 19837 - DNA, 1847 bp, Homo sapiens
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctggatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19838 - DNA, 662 bp, Homo sapiens
  misc_feature (643)..(643): n is a, c, g, or t
tccgctctctacccccccctcctctctctcccccctcgccccttcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggagttggctgtgtgtgggcgtcttccattttaccgaacatganccaggctcttgttttggcg

SEQ ID NO: 19839 - DNA, 2269 bp, Homo sapiens
atcgtatctgggacctcgaactctcagcatgagtcgatctaagaattggaaacgatcatgaaatgagtgacccacaggggaaaaaaacattcgtaaggagagaggcagcacatactttaaataagcacgcggtggctcatgcctttaatcccagcactttgggaggccacggtgggtggatcacctgaggtgaggagtttgagaccagcctggccaacatggtgaaaccctgactctactaaaaatacaaaaaattagctgggcatggtggtgggaacctgtaatcccagctacttgggaggctgaggcaggagaatcacttgaacctgggaggcagaggttgcagtgatccgaggtcacgccattgcacccagcctaggcaacaagagcgaaactccgtctcaaaataaataaataaataaaaagtttgtgctgttaatttaatggggttgggagagtgaacaagttgttttcatcaaacaattctagagttttggagtggggtgcttaggaacgtcatgttttctgacattgtgacttactcctgttgagctgctcttcccgaagcactgaggcaggagtgctctccacccaacaaactgacctcccagttaacattccttagcaatgcgagtcaaagaagtgcttttaagtgtctctgatttttaacacatcactctgcaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 19840 - DNA, 354 bp, Homo sapiens
cctacccagagattatgcttcccagactcacttgcagctaggtatggccatgtgaccaagatttgaccaatgggatgtgagtggaagtaacacatgcaacttccaggtcatttccttaaaaggaaactgtttgcccttcccctcctcgttctccttggacttggtcgtggtaatagcttcaaccatgtggaagagaacaattccatatgggatgatggagtactaagatattaggaaccagggtgctcaggtaactttacggagcagagccaccctgatcggcctgcctgcctacctctggacttgtatgtgcaagagaaataaatgtttatctttttgcgtctcttgttttac

SEQ ID NO: 19841 - DNA, 460 bp, Homo sapiens
ggagtcagaacagattattccaatgtttgaaagacaggtggttcctgtaagttttatgcaaggtgtttcctgaatgtgtgcatagccaagctgctcctggaactattctgtgtttaccttagattttgtgtttgccctatttgacatatattaagtacagggacaaactaaaggctaaagttgtttacatcatccttttaagccctctctcgtgggtgcacaaaactcatatcacagacttcccagtgacaaccatagaatgtctgtttttgctttatgcccaacaggggacatccccacctagatccatcccactgacttagcaataaaggcatagtctcaggtcctctctctgctttgtggtctctgcttgtgacagagtttcatgtggccccctgtggcatgccatgaccctcatttctggggagaattgtaacattaaactttcttttcaatggca

SEQ ID NO: 19842 - DNA, 948 bp, Homo sapiens
ggagtcagaacagattattccaatgtttgaaagacaggtggttcctgtaagttttatgcaaggtgtttcctgaatgtgtgcatagccaagctgctcctggaactattctgtgtttaccttagattttgtgtttgccctatttgacatatattaagtacagggacaaactaaaggctaaagttgtttacatcatccttttaagccctctctcgtgggtgcacaaaactcatatcacagacttcccagtgacaaccatagaatgtctgtttttgctttatgcccaacaggggacatccccacctagatccatcccactgacttagcaataaaggcatagtctcaggtcctctctctgctttgtggtctctgcttgtgacagagtttcatgtggccccctgtggcatgccatgaccctcatttctggggagaattgtaacattaaactttcttttcaatggcattgatctctccatgtcctctctgtcacctttataaattaagatttaaaacaagaatgcatgcatagctgcttgtcagggggctggagggtgagaatgggtagctgctgctgatcagagagctgaaattcgctgaaattaaacactatttaccatctaagccttccagtagacccttcaaaagattgaggtgtccaatcttttggcttccctgggccacattggaagaagaattgtcttgggccacacataaaataccctaacaatagctgagaatctgggtaggccaagatggctagagtggaaggctgagtaccagagagaatagagaaagaactccaggtatctgcagagggacctccttgagaaactactggaagatagggaaataaacatctgaaaagatttgaaggaacaatacctgactcattcaagaccaagaatagtgtctttctaccagctggactggaaaacctcataatttatgggg

SEQ ID NO: 19843 - DNA, 259 bp, Homo sapiens
taagccaggtggagcaggcagagcgatcagtaaaagcccaaggacatagaggctttcacagactgacaaagaatgtttacttttttcattcacctgaatagctactgcaaagaaagtgatgttacagccacatctctatcaagattacaaccttcttcaggagcacattacagcagagaattcctactatgtgccagaagttacagccaccatcttccatttgaatagtgaactcattttatctttggaaaaaaaaaag

SEQ ID NO: 19844 - DNA, 142 bp, Homo sapiens
aggcaccaagttcccaggctgcaaccagcaaggggattctgggcccagccacaaaaccactttttcctcttaaacctccaggcctgtgaatgtcggggggatgtgatgaagacctctgacatgccctgaagactccatctca

SEQ ID NO: 19845 - DNA, 256 bp, Homo sapiens
ctctagtagccactcttctgggggcttgtcccttaaatgattagtccttaccgacctattttctgtccactttatctgtttttgagagagggtctcactctgttgcctaggctggagtgcagtggcatgaatatgggtcactgcagcctccacctcctgggctcaagtgatcttcctgcctcagcctgccatgccatgtaactggggccacaggcatgtgccaccatgtccagctaatttcttgatttttttttgg

SEQ ID NO: 19846 - DNA, 422 bp, Homo sapiens
aatggataggctgtgcaccttattggctctagttcttcatgccgaggcgaggctcattaggagggcctggctcattctctagatccccttagatggaaacctaggaacaaacaggtggccaattagggccaggaagaatgcaagtcacaaattaagctgggtgtagtagctcatgcctgtaattccagaagccgaggcaggaggattacttgaggccaggaggttgagaccagcctgggcaacatagcaagaccccatctttacaaaaaaaaaattagccaggcatagtcatacacacctgtaatctcagctactcagaaggctgaggtgggagaatcatctgaacctaagagtttgagcctgcagtgagctatgatcatgccactgcactccagcctaggtgatacagcaagactctatct

SEQ ID NO: 19847 - DNA, 255 bp, Homo sapiens
attatttttgtagacattgggtctcactatgttgtccagactggtctcaaataaaactcgcacctcagactcctgagtatcagttttttaatacagtatttttcctatttcttcttggcctgatttctccctgtcctccatcttcaacacaaatctccataccaatcacatcacatcacgtcacgtcatgcaagcaaggtaacacttgcttgtgttgtcctaatgttcattcttccatgtttctcttcatttcat

SEQ ID NO: 19848 - DNA, 400 bp, Homo sapiens
gtaagaatagaagtaagaagaataattagggagctactgaagtcattcaagcaaaaactgatggtagcctggataagactgttcaaaagagaaggtgaaaagtcattagattcaggatatattctggatgttaaaccaaccagatttattggcagattggatgtaaagattgaggggaagaagagaatcatgaaaaacccctaggtttttggcctgaagagctgtggttctgtggttttggtagacagaatgatgctccccacacccccaagatgaccctgttctaatcccttggacctgtcaatatattactttgcatgaccaaaaggattttacaggtgtgattaagttaagagccttgagctggggagatttgagccaaggaatgcaagcagaatcc

SEQ ID NO: 19849 - DNA, 357 bp, Homo sapiens
gaaaacaaaccctgagttttaaacaaattgaaacttgtaaaaatgtagcccatgggtaaactgggcattttctgagaattttgtttcataaaatatgtatataagaacttagagtttcaatttctttaacttgtctgggtatgaagttcagcagtctccatctcttagaagtagaaaccaggcagggtgcagtggctcatgcctgtaatcccagcacttccagaggccgaagtgggaggatggcttgagtccaggagtccaagaccagtctgtgcaatatagtgaaaccccatctctacaaaaaaatatataaaaagtagccaggcatagtggcgtgtgcctatagtcctagctacc

SEQ ID NO: 19850 - DNA, 431 bp, Homo sapiens
cgtcagccaccacacctggcccctcatggcagttcgaacaatgatactattacaaccttgtggcctccccaccccggtactcagtttatagatggggaaactgaggcacaggaaagttaggcaaggtgcctattaaactcaaacagggccaggcgccggggctcatgcctgtaatcctaacactttgggaggccaaggcagaaggatcgcttgagcccaggagtttgagaacagcctgggcaatatggtgtaaccccgtctctacaaaatatacaaaaattagctgggtgtggtggcatgcgcctgtagttccagctactctggaggctgaggcgagaggatcgtttgagctggggaggttgaggccgcaatgagtcatattcttgccactgcactccagcctgggtgacaaagtgagaccctgtctcaaa

SEQ ID NO: 19851 - DNA, 416 bp, Homo sapiens
agacagagaagcgaggcagaggtctagaatctcagggcagaagggacttggggagaactggggtccatttctttcttcttccaataatagctatttttatttttaaaaaataagagaccatttgatcaagcatctattttatgtggggcatttttgtgcctgacagcaattctggctggtttttttgttggtttgtttgtttgttttgagacggaaattttgctcttgttgcccaggctgttgtgaaatggcatgatctcggctcactgcaacctccgtctcctgggttcaagcgattctctactctggaggctgaggcgagaggatcgtttgagctggggaggttgaggccgcaatgagtcatattcttgccactgcactccagcctgggtgacaaagtgagaccctgtctcaaa

SEQ ID NO: 19852 - DNA, 398 bp, Homo sapiens
ttttgcttgtttgctttttcttgagacggagtctcactctgtcgcccaggctggagtgcagtggtgcaatcttggctcactgcaagctccacctcccgggttcaagcgattctcttgcctcagccaaccaagtagctggaactacaggtgccggccaccacaccaggctaatttttgtatttttagtagagatggggtttcaccatattggccaggctggtctctaactcctgacctcgtgatcctcccgccttggcctcccaaagtgctgggattacaggagtgagccaccgcgcccaacctatcttgttataatactcaaaatcagacccaaaggtggagatttaacaggctaatgagacacgtggctcatgaactgcaccggtgtgaaaagttcc

SEQ ID NO: 19853 - DNA, 5240 bp, Homo sapiens
  misc_feature (2582)..(2582): n is a, c, g, or t
gacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcgttggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggngtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggctggcccactccaggttcctacataatctcttctgttccagacacagaaacagacatgttgatttcttctctttctggagggcctacaagggtcaggagtgtcatggtttacttcttcctaatgttacaaaaaattgcttttaccattcat

SEQ ID NO: 19854 - DNA, 5236 bp, Homo sapiens
  misc_feature (2582)..(2582): n is a, c, g, or t
gacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcgttggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggngtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaagatgcatgagactgggagatactgcctcaccttattatattcttcaagtctgatcttaccttggtgtgcacacgtgctaagatttgcctaatgatgttgggaggtgaagctgaagtgatgagagttgtgcagggacttacttcctcatccacctcccaaaatgaccctggcaaaggaagtgggggtgattcataattcatttaaaaactgaagaccaacttctcacagatgtggggatgctgttcaaggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctgggagtgtgaagcaggggtaggcaggagactacacacttccagagacccaggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggctggcccactccaggttcctacataatctcttctgttccagacacagaaacagacatgttgatttcttctctttctggagggcctacaagggtcaggagtgtcatggtttacttcttcctaatgttacaaaaaattgcttttaccattcat

SEQ ID NO: 19855 - DNA, 1862 bp, Homo sapiens
ctggcctaaagatattttaatatcaaaagtgatactgtataagttactattatttatttctgcatatggacagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaaggaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggctggcccactccaggttcctacataatctcttctgttccagacacagaaacagacatgttgatttcttctctttctggagggcctacaagggtcaggagtgtcatggtttacttcttcctaatgttacaaaaaattgcttttaccattcat

SEQ ID NO: 19856 - DNA, 429 bp, Homo sapiens
atggattattttgacggagtcctgatgtttgttgatatttcaggcaagtgcaaaagggatgtttgtttaatgtggatgagcaacaggctcgcgtgggaattcacatgcagagcttgattgcagagtagggaggccattctggagcccttgggctgtcacagcagatgtgctccactgagaacacaagagggaggaaatagcttgtggccctggctctctctcatcctcccttactcaggactgccagtcataggcatatctttaacatgctcaagtcccattctttgctccagtatctctgccccaacttcactgactcatcctctccagccccaagccccatacacatcccagtcaaaattgacctcaggaaatgatctccctagatgatgtttacatcttactaataaacttgccacctcttcagaa

SEQ ID NO: 19857 - DNA, 132 bp, Homo sapiens
aagtgttgatttttggaggagacatcctgaaatttgcaggtatgggggcttactaagatagaaggggtaagaaaggagtgctgaggtgcctgtgcttctgtgttggggacaaaggaggcatcctagagaagg

SEQ ID NO: 19858 - DNA, 580 bp, Homo sapiens
ctgtcctgatgatagctgcgttcctccaacccatacgagatgttcagcgggaaagtgaaggagagaagaaatcagtacctttctggtccactttactgtcgactttcaagctatatagagataaacgtctgtgcctcttaattctgctgccgctgtacagtggattgcagcaaggattcctctccagcgaatacacaaggtcctatgtcacctgcaccctgggcatccagttcgtcggctacgtgatgatctgcttctcggccactgacgcgctgtgctccgtgttgtatggaaaggtctcgcagtacacgggcagggctgtgctgtacgtgctgggcgcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcatgtttttgtgcgt

SEQ ID NO: 19859 - DNA, 667 bp, Homo sapiens
tttttaaggaaagatgattaagacctagcctcaggacacagacaaaactaagggcacgttaaagtctctaaaggaattaagacacccccacctcgccctaccctaaccctagtaaatccttttagttgagcaaaattgctacaggaaaagtgattagtgacatggtctcacagaaacctgataagctcaaagtggcctgtaattaaatccagaaggagagatatgtctggtaaatagttacctcaaaagaggtgtaggtgtggctactggcccagggagtaactaaaatcaaatggaaataaaaattgatcattgtttagcatgaatgatatccccaaaagagacaccagcctggtctaaaagagactgtgaccacaggggacctaaaacaacttttggcaccccaaattgctataagcaggaagtagcctgagaaagctaccaagtccccaatgaagatacattctctaatactttttcaggtgtgtccgaacaggatgatcaaaaaggaaaaatctcccagagggagaagtcaaaagtcagagagaggccaggcgcggtggctcacacctgtaatcccagcaccttgggaggccaaggcgggtggatcacgaggtcaggagttcgagaccagcctggccaacatagtgaaaccccgtctctacta

SEQ ID NO: 19860 - DNA, 252 bp, Homo sapiens
ttttcccctaattttatattccctgatgctaactatttgatactgagcagagaatagtatttagttgcagctgtagtactttcgaatgttgtgtcatctttctctgacacccagactaacaagtaagttctttaacagcattactcagcattatccagttttgacttgtgttcacctgtgttcatgttaacagcatcagtgttttcacaggcaatttttttaaacctaaattatagttaaaatcagttttac

SEQ ID NO: 19861 - DNA, 796 bp, Homo sapiens
atctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattc

SEQ ID NO: 19862 - DNA, 508 bp, Homo sapiens
cagacctaggagaacaatattttcccttctgtcgttttgataattacatcctctgtgctcagtggtggcctattaactcacatgaataccatgggcttgcaaaatggcctcaaatttccatatattggaactgtgagaactttctataatggtgctttagcaataatgatggaggtgcaggcatttcctgaggattaatgaccagctgggaggaaccagtggcccttggctctgcctcccagccagccattaattctaaggaaatgtcttttgctgaggtcgttactgctattataagcttaaaatggaaaaacataataggcatatgagttatttttatgggttgatgcagtttccaatggtgtgtactaatttgagaaaatgaatgtgtatacatacaagagtaagtcagattgttagactcatccctcagtattccatatgttttgtgactgattttacagttctctctacctttctcatttacaaaaaaaaaaaagaaaagaaa

SEQ ID NO: 19863 - DNA, 2411 bp, Homo sapiens
caaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaa

SEQ ID NO: 19864 - DNA, 2436 bp, Homo sapiens
caaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaaaaaacaacacaacgacacaaaaaca

SEQ ID NO: 19865 - DNA, 2398 bp, Homo sapiens
caaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattagtattttatttttcccttcctaacactcaaattcatggcaggtgaaaagataatagaacataatc

SEQ ID NO: 19866 - DNA, 2358 bp, Homo sapiens
caaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagttggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaa

SEQ ID NO: 19867 - DNA, 226 bp, Homo sapiens
tagaggctgaagctttaaggaggatgggaggggaggcttcacccggaaggagcttttggagcaagggcctgaaggaaattggggagagagcctgagtatctttggtaactgggaagagagcattccaagcaaagggaaaagaagagaggctgtcagacaagtgtgcacccaccatgtctgggcacatcgagaaggaccctgtggctggaggggaggaaggagggga

SEQ ID NO: 19868 - DNA, 308 bp, Homo sapiens
ttgcttcctcaccctatttgtgatatgaaaataaacaaatcatttgcttccaactaaaggtagtggacagaactcacctgtttttatctctactccctgaggaagtcccatcaaaatgaaagtaaggaaattgaaaaaggcatgaaccagtggtttttaaccttggctgaacttttgaaatagcagcagagatttttaaaaatcctagtgtccagcctgtagcccagataaattgaatcagaacctctgcagatgagactcaggcatcaagatttttatactatatattttttcaaagaaaataagag

SEQ ID NO: 19869 - DNA, 293 bp, Homo sapiens
ccacccttggtcaagctgcatcatctcacctgaattattgcactggcctcttatttggcctttgtcctccaatcttaactcctctaattcgtttccactccttcagtagctagactgaccctttaaaacactaagaaatttttaaattccctgattaaaaaacttaattgggtgggcctgccacagtggctcatgcctgtaatcccagtgctttgggtgactgaggtaggaggattgctgaggctaggagttcaagatcagcctgggcaacatagtaagaccccatctctacc

SEQ ID NO: 19870 - DNA, 286 bp, Homo sapiens
atgagatagtcaacactttattatgaaataggcctcgtgttagatgatttgcccaactataggctaatgtaactgttctgaacacatttagggtaagtcaggctaagctaccatgtttgacaggttaggtgttataaccattttctacttatgatatttttcaacttacaattccaggacaaaaacctttggtaaatcaaggagcatctgtataaggattaggtcatggggaaaagcaaaaaaacagcattttcacacacaaaaaaatcacttaggtgattaaggg

SEQ ID NO: 19871 - DNA, 209 bp, Homo sapiens
agatcatgccactgcactccagcctgggcgacagagcgagactccgtctcaaaaaaaagaggaatggaagagattagaaaagatgtgaacaaaccttatagagcttccaggaaaggaagaaaggtaaaaacattgagatttggaatgttgagtaatgggatagtataaacagtatagcagtatagagatgtcactaatgttttagaaac

SEQ ID NO: 19872 - DNA, 376 bp, Homo sapiens
tctcatacagaattaccgttacctgacattatagatttgtttatttgttctttttttcttctcatatgttatggactgcatgtttgtgtacccccaaattcctatgttgaaatcctaatccctaatgggatggtattaggaagtggggcctctgggagtgcttaggtcatgaagatggagtcctcttgatgggattagtgcccttataaggagagacaccagagagcttgcttctctctgcaatctgctatgtgaggatacaagaagatagtggtctgcaaaccagaaagagtgactcatcagacactgaatgggctggcaccttgctcttggacttgccagcctccagaactgggagaaataaatgtctgttgtt

SEQ ID NO: 19873 - DNA, 408 bp, Homo sapiens
gataactcgatcttggacttcccagtcttcagaactgcgagaaataaatttcttttatttatgaattacccagtctgtggtatttggttatagcagcacaagtggactaagatacaccctctgtcctacctcttatgctctgtacccccttcattgtgttgcatttctctacaacatttaccattccatatcctttatatattgttaatctctctgtccctagcttgagtgtaagttcagttaatgcaaggaattttccctgctttgtctgtttgctttttgtttctcctagtgctgtttttccaatactcagaacagggcttgatatataatggaagctcagtaaatatttattgaatgaatgagtgaataaaaggtatgttcacaaggaccttctgctatgacatc

SEQ ID NO: 19874 - DNA, 1918 bp, Homo sapiens
cactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttgg

SEQ ID NO: 19875 - DNA, 1022 bp, Homo sapiens
cactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcaggaggctgaggcaggagaattgcttgaacccgggaagtggaatttgcagtgagctgaaattgtgccgctgcactccaacctgggggacagagcgggactgtagc

SEQ ID NO: 19876 - DNA, 202 bp, Homo sapiens
ctcctgggttcaagtgatcctcccaccttgacctcccaaagtgctgggattacagacatgagccactgtgtgtggctgtgttttttctttcttctaaattctcatagaattttagttttgtggataaagcacaataatcttttttcttttgaaaagaaaatcggcaggcaagaactatgtgttctgtggactatgatttata

SEQ ID NO: 19877 - DNA, 559 bp, Homo sapiens
ctttctccttccttctgtgcattcttattgggatccagagagtgcatggtgtttttttctacctgccagaggcacaaatgtttgtgtcttcattcagaggtgagcagctgtcaggcacgaggtgcataagcatccagcccctgctcccctggggctggctaagcccaagtcctttgcacttctaggaaaaactcctgctccttgtgtgtactttcctctcaatgctcattcccgtgcccatctttctaaacggcatcactagatcaagatttggcctcccgtggccactctggggtacatttgatttaaacaaaattcctcaattgagaggtgccttaacaagaaaggaaataagatttctcaggcccagtgagtagtagttgttggttggtacgcagaggattccaaatgacatttggaataaaaaatcttctcattagtccaggtacagtggctcatacctggacagccagcattttgggaagctaaggcacaaaaatcgcttcaagtcagttttagtccagcctggacaacataggaagatccagtccttaccaaa

SEQ ID NO: 19878 - DNA, 470 bp, Homo sapiens
agcgcacctggccagtaataacattaaatgtgaatagattaaactatcaaaagacacagattgtcaaagtggtgataaaaaaaaatccaaccatgtacagaagacatacatacatactcaaagatacaattggattagaagtaaaggatggaaaaagatataaaacgcaaacagcaaccataataaatctccagtggctttctaatatcagacacaatagagtttaaaacaaaagttttactagagataaagaaaagtattttgtaaagataagtcatcaagaagatgtaacaattataaatagacaattgggattacatcaagctgggaagcttccatactgccgaggaaataacaaaataaagagacaacccacagattgggagaaaatatttgcaaactatccatttgacaaggggttaattgccagaatatacagggagctcaaacaactctatagcaaaaacaaa

SEQ ID NO: 19879 - DNA, 845 bp, Homo sapiens
tagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttatttttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggt

SEQ ID NO: 19880 - DNA, 548 bp, Homo sapiens
ggtagccagctgaacctccagttataactgagggtgccaagagtgagctgttgagagcagcgaggacagaggttttcccagccaggattgcggtactgagacatgcacacacgtgcatacacatgcacagacatgtacactcacaccctaaattgcttgtgctatgtgggaaattttgacccacatattcctatgtttaattgaaggcactgttaacttcttaacaatgctacatctctgatgattttaggaggaattagactgcgtaaacatctcaaaacagggaggtgaagctaggaagcataaatgccccagtgatggctgcaactaggtctcttaacttattgtaatctaaaccttgggtgagggagaaagaaaaaaagagcagctttttaaagtccactgaagacttcagatgtggcaaaaataatcattttttttctggccatgagaaattgtctgagtagagggtggaaaatttcatccttatcaggaagttaatcatagtaatttatgtggaacttccaggtggttacttagtcaatctt

SEQ ID NO: 19881 - DNA, 462 bp, Homo sapiens
gaacttgagaccattgtcacacacagggagaaaagcactggaatggactagaagtctgcctggggaaacatgtggcatgcacttacagagtgttacatgtctgtcatccttgaggagtcattgtggactctcaagggtccatgataggcatccacttgcctctctagcctgaagaatgtcatctgcagccttgctcctcaaagtgggaaccttgcttttcaaagcagcgtcttcagaacagcagcatcagcatcacaccggagcttattaaaaatacagactctcagccccacccctttcccccacactacccaatcagattctgcattttaacaagattcccaggggatttgtatgcacataaacaatggagacggctaggagaggtggcgcatgtctgtaatcccagcactttgggaggctgagggaggagaagcttgagcccaggagttcgagaccagc

SEQ ID NO: 19882 - DNA, 885 bp, Homo sapiens
gccataccaaggtcattgtcctagttaggaatgtgggacccttacactgggatggggacatctggatcgatactctagaactctagaaaacctggacaccccagccccgccaccctcccccacaccctgaaacctctaagcccactcctccctgttaagggccggtgctttgctcttgtttgaaggtcatgcccaggcctctgccacctccccttaggatctgtgctcaccacccctcctggcccctggaccaagaaggtcagcaggagggtgctgggcctgccagagaagaaagaagatgagctgcctggggggagcaggagtgtgcctgagacaagggcatggccatatggggctctgctatgacctaggactcagcacccttgcagagcccccaggaagcagtgcccgtaggctgccagctcggtcggctctctgaaacttcccaggaagccatggcccacaaggaagagaatagcaacctaggggcaaccgtggcagctctgcaagaagcgaagggaatagagtaccctaggcctttgggaagtgtaagtggaggagtgactgtgaccttgagagagatgttgcgggggttataggtgatacctcggagaaagataatgaaaagctgatcatgactaatcactagaaaagacacgatgtgagatccgttagaggcctccttggcagccaggcaagagggtggacacagctgaagggatcaggcatggggttgttactaaggcttcagagctccaagaaggtagaactttcaacctagccgagagtggaaatgcagctgacccctgaacaacgcaggtctcaactgcctggggccacttacatgtgggtttttcaataaatatattggaaattttttttgaa

SEQ ID NO: 19883 - DNA, 644 bp, Homo sapiens
gccataccaaggtcattgtcctagttaggaatgtgggacccttacactgggatggggacatctggatcgatactctagaactctagaaaacctggacaccccagccccgccaccctcccccacaccctgaaacctctaagcccactcctccctgttaagggccggtgctttgctcttgtttgaaggtcatgcccaggcctctgccacctccccttaggatctgtgctcaccacccctcctggcccctggaccaagaaggtcagcaggagggtgctgggcctgccagagaagaaagaagatgagctgcctggggggagcaggagtgtgcctgagacaagggcatggccatatggggctctgctatgacctaggactcagcacccttgcagagcccccaggaagcagtgcccgtaggctgccagctcggtcggctctctgaaacttcccaggaagccatggcccacaaggaagagaatagcaacctaggggcaaccgtggcagctctgcaagaagcgaacgaacgcccagagaagcgggtgtgggagagtggaaatgcagctgacccctgaacaacgcaggtctcaactgcctggggccacttacatgtgggtttttcaataaatatattggaaattttttttgaa

SEQ ID NO: 19884 - DNA, 248 bp, Homo sapiens
tccttagagagacagggtctcgctatgttacccagactggagcacagtggctgttcatgggcgctttgtggctcatgcagcctcaaacccctgggctcaagcgatcctcctgcctcagtcccccaggtagctgggactacaggctcacaccactgcactcagcttacatttgaatgtatttaagtaactccagtcagcctcagctcagatgaactcaaattttatttctgcaactttatattaaaata

SEQ ID NO: 19885 - DNA, 325 bp, Homo sapiens
cagagtaagaaaaaatccgtttgctttttaaaatccaaagatggttttgagaacctgaaaccaagttagagcaagttcgttttccttccaaaaaaactgggctctgccgggcgcagtggctcacgcctgtaatcacagcactttgggaggctgaggccggcagatcacgaggtcaggagttcgagaccagcctgaccaacatggtgaaaccccgtctttactaaaaatacaaaaaattagcccgacgtggtggtgcgcacctgtagtcccagctacttgggaggctgaggcaggagaatcacctgaacccaggaggcagaggtta

SEQ ID NO: 19886 - DNA, 188 bp, Homo sapiens
gggagacaagagtgaaactccatctcaaaaagaaaaaaaaaagcccttttcacttattaggtttcactgtgccaagtattcccttctgttggtttgtaaaaagcaatgacagtgaagaattctccttggaaataatgtatagatctatttccctcttaaatctattttgtaatatatctaattttata

SEQ ID NO: 19887 - DNA, 315 bp, Homo sapiens
acatggactggaattcttccataggtaatgaaaatggcagatattaagaagctctagaaaggagtgaagcttttaccttttgtccggtcataaattacacgtttgaccttggataggatgaatacaagcatgattcaattcacttcaactcaactcaaggaaaaactagttatatatatgtatgtatagttatacatatttacatttactgcaggcacagatatgtgctacagcccaagaagaagatggtgaaattccaatttcatacctctctcttcttctttctctagaactttgtatataaagcaacaaagc

SEQ ID NO: 19888 - DNA, 280 bp, Homo sapiens
caacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcat

SEQ ID NO: 19889 - DNA, 340 bp, Homo sapiens
aaaatttgaagtgtgcataggcttttgaccaaatagttccatttctagaaatttagctacaaaaaaaattctcacacatgtgcacaaagacctacgaacaaagatcttgaatctttcagtttgcaatagtgtccacagaagaatggttaaataaagtacagtacatccgtactatcaaattttatgcaatgttagaaagaacaagataactaacatattgacatggaaagctctccatggaaatttgtgggacctctggattatgcagctggaacatagcctcttaattgcagcatgtcccacattgttacctcgcttttacttatttcagttaggtttc

SEQ ID NO: 19890 - DNA, 341 bp, Homo sapiens
cacacatacattatatttcaactatttctagtatacggaataacataaatttttaaaattatactagtaatgccaagaaagaccaattttaagattggaagtgttggcccggcgctgtggatcattcctctaatcccagcactttgggaggccgaggtgggcagatcacttgaggttaggagttcgagaccagtctggccaacatggtgaaaccccatctctactaaaaatacaaagttagccaggcatggtgttgggtgcctgtaatcccagctactcgggaggctgaggcaggagaatcccttgaacccagagggcagaggttgcagtgaactgaaatc

SEQ ID NO: 19891 - DNA, 285 bp, Homo sapiens
gtgtgacgagcccttggctccctttcatgtccttcccttcagttcttccctcaatcatgctcctccagccatgcaggcccttttgccattcctcatgcacaccaggccctcccctcctcaggacctttgcacctgctgtcctctctgcctgagatgttcaccatctaaatgagctcatccacagctcacttcctcatttcattcaagtctttgctcaagcgtcacctctgcaaagacattctctgtgcaccctatgtaaagaggctcacccttttcattgatttt

SEQ ID NO: 19892 - DNA, 478 bp, Homo sapiens
cctgtataaattcaaggtgcaaaggcaacatttcctggctgggagtttactggcagggcggcctgtgcagagcatctactcttgctgttgaagtaactgagggaaaggtgctgatcttgctaaggagaacacaagccctaatcaagccaagctcacctctatttgagtgcttttggtgcagtttgtggcttttttccaatatggtaagtttcctttggaatatatttagagcaaaattgccattgtcatggtatttttgttttgtacaagcttcaaaattactactttggaatgagaggtatagttgagttggctggctgtgagtttaccatttgtttctctttagccaagagatcattattataatgtttcaaataattttccacttaaattataccattttctctaaatccaactgcttagtatatgcttagtaaaccaaaggattggtatgaggtgtaataaagtacattaaaat

SEQ ID NO: 19893 - DNA, 385 bp, Homo sapiens
tttttttggaaatggagtcttgctctgtcacccaggctggagtgcagtggcacgatctcggctcactgcaacctccatctccggggttcaagtgattgtcctgcctcagcctcctgagtagccgggactaaggtgcctgccaccacacccaactaatttttgtatttttagtagagacggggtttcaccaggctggtcctgtgcatgaccacttccaacatggcacaaaaaaatgatgcaatagcaactgcaggtagctgtggataaataagcctggaacaacatcgtggtttcctgtggccagtccttttcatgcacaggatccacatatgcccccagggaatggatacagaagtgttaagaggcttggggttgtttttttttt

SEQ ID NO: 19894 - DNA, 386 bp, Homo sapiens
attatgagtatagttttacattcatgctttatattcatgtccatatttgagtggcttgtttctgagctttatatattccgttccactgttctctttgtctttgattcaataccatactccctagtagttgagactattcgccaccacacccaactaatttttgtatttttagtagagacggggtttcaccaggctggtcctgtgcatgaccacttccaacatggcacaaaaaaatgatgcaatagcaactgcaggtagctgtggataaataagcctggaacaacatcgtggtttcctgtggccagtccttttcatgcacaggatccacatatgcccccagggaatggatacagaagtgttaagaggcttggggttgtttttttttt

SEQ ID NO: 19895 - DNA, 282 bp, Homo sapiens
ggcagatgcaaccacagatacagcaaagattcaaaaagataaaagaatataacaaacacttaatcccgttagtttttaaatctggcaatctaagggtgattttacaactaccatattgaaaaattaaagaggaaaatcttatggtcttttcaatagaagaaggaaaatcatttgacacaatttaacatccatttgctaaaaacttttagcaaaaaaaaaaagcaatagaacagaatagaactttcttaattgaaacatattttccaaaaccatgcggcaaac

SEQ ID NO: 19896 - DNA, 755 bp, Homo sapiens
ttcctgttcttcactttttgaaataaacataagttacatctcttgctcgcaaaagctggaattagttgtacttgtttctgtacttattctctctatggtgtaagctcccaggggcaagatacacatttatcacttcttttgcatgttcctacagaatctactacaggactctgtcacagcagtcttttagtaaagtgctggactggctgcctaaccacagtgtctcagctggtgctataatccacataagcaactccttctgagggtgtgatctgtaactatgatggcagactatacaataagattacaactttaatcggccatgattatgaaatatttctgaagatccttctcgaggggggtgcttggaagcagacacaggtatgaggaataaatgccagcccacctgctggcgggagaggcaatgggaccatctcttcagacagatgagcaagcaggaaaacagagaatacaacttgtcttggaagctagcagcaagatgaggcagtaaaacccatcagcatacatcatcctatcattgcccagtgtcatccccagcctctattagccctcgctgcatcagcgcaagtcccagacactttatcctgtttataattgctgatgagcagtaataaggcctccatgcctcagctccgtctgttccacttcggcacccacctattatgtaataacttttatttacagccttgcttgatgcgctgttctattagtagagccaggaactgagtggggca

SEQ ID NO: 19897 - DNA, 483 bp, Homo sapiens
cgtaattctcaaacttctctgcacattggaattacttggggagcttcaaaaaatcctgaagcctttttcccacccttagagatgtgtggcctgagatttggaatttttttttaatccccagtaattctagtgccctagggctaacaattttagaacttgccctccctacttcacctctgaataacaaggtttccacgtctccatccagtcaaagaaggaatggtaagcaagtgtctatcatgtacactttattaatcgtgattattaatttctacattatttctaatcatggcacctagtgttgagtagactctttaggaaagaattctgtcttcagttatggatgctgccaatggcagggcaaagggggagagtggcagtgcaggtgccacgtatttgtaagccctgattagaatatgaagaagaaatgggaatatagcagcaaaaagaaaaagaataaaaatcactttgaaaatttaatgt

SEQ ID NO: 19898 - DNA, 161 bp, Homo sapiens
aaaagaatatggttcatattaagtattattgtaatggacatttggattttgttccttttaactctgtgttggtgttctgggaagtgtgttgaactagacaaatgtatatgtgtagtggagcagttcagttttttttaatgacagtctaagtgttgggctac

SEQ ID NO: 19899 - DNA, 474 bp, Homo sapiens
attatttctaccaccctacatccctttagttttccttctcggggtatttggtgtgaccctaagaacttggtcccgtttaaacgactcatgtccatcccccctccattcgagcagtaccacatgcttgatatataaatgttacagctgagcgtttgcagtagccttgagatctgagtctagtatcagcccaaatgaggtgcgagtgacttctgatttcagggggataccattcttcattgagctggtagatggacctagtcacactttgtgggatttttgttgtttatattcaagtatagaaaatattccacagtaaatacttcattccttaagccctttttatgtgcataatactgtatttgggcaatgcaaaattgaattggatatagaatctgccctctaggagcttgactgtagtaaggcagagaaagcatgttcaaaattaagttaaacagaatagagcatgagtgccag

SEQ ID NO: 19900 - DNA, 277 bp, Homo sapiens
aacggagagtttatatatggacacctaccaagcctgggaatagtctctggttgggtccagtgcaaacatctttaatccccagagcaaaggggtcctgccgctcatgcccactccagggcaggagcctggctgggaaggcaaaacaatccctgatagctgttcccatcgccagggagaaatcctaaatttggcaacctcaggaagtgaacaagtttcctttttttcccccagggtcagagacctggcatagaagtataagaggctgcggagtttttaa

SEQ ID NO: 19901 - DNA, 743 bp, Homo sapiens
tagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggaa

SEQ ID NO: 19902 - DNA, 718 bp, Homo sapiens
gatattttgtctcctcacccccctgtctccaacatcctgtttcatcacaaatgtttatcattttactcattggttctccacccgtcttgtgggctgctgtggttgctgtcacccagccaagaggctggggaatgcctgtccacaagcagtaaggggcatctggctagggtgctcagaagttcctgagcattgtagtatcagcattgtgaggccattgagatagggagagaacaagcctatttaaatagctgccagaacaatcaatacaagcaccattgttgctagtcatagtggaaatatacacactgtctttagcaaagaaaaaactgaagtgtacaccatttgaagatgtcatactgaggtgttctgaaagcatcaaaagagaagaagaaaaattcctatctaaacaatattactatcttaaaaaggctattctatttgagtggttgttaactgttttaaagaatggtttggtttgcctgagaagtttatttggtattaattagctactcactttaaaaatatttaatatgacacaagatacaatatgatagtaccatggcacagtctacttgtttcagatggaattgacattttggaagagtatgggccaggaattttgtagtctgggcttatgggttttgggggcagaataccaccaggcgaggttcccatctcatcacattatgttaggaattgtgtcacatcaacatgcctt

SEQ ID NO: 19903 - DNA, 540 bp, Homo sapiens
tccaccgttgatcaccggtggattggatgaagaaatggtggattggtacatgtatatcatggaatactgtgcagccgtagaatcaaatcatgacctttgtagcaacatggatacagctgaaggcgattatcctaaatgaattaacatgggaatagaaaaccaaataccacattttctcacttataagttggagctaaatattgggtactcatggatataaagatgacagcaatagaaactggggactactggaagtgggaaaagggctgaaaaattaactattgggtactatgctcagtacctgggtgatgggatcattcatacctcaaacctgagcatcgtgcagtatacccaggtaacaaacctgcgcatgtaccccctgaatctaaaataaaagttgaaaaaggaaaacggaacaacaataagcccattttccatagtggtaaagatacaggtgtcatacatctattttaaaaagaaaaaaaattgaaattaatgagctaagcagtcatttgaagaatggtgaaaataataaatcca

SEQ ID NO: 19904 - DNA, 1770 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaa

SEQ ID NO: 19905 - DNA, 1755 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaa

SEQ ID NO: 19906 - DNA, 275 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacttcctgccccacccagtgggtaggccaagtgtgttgcttcagcaaaccggaccaggagggccagggccggatgtggggaccctcttcctctagcacagtaaagctggcctccagaaa

SEQ ID NO: 19907 - DNA, 1920 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaaaaaaaatattattattgtctttcttaattatccctttataatcttatggttgattttaagtctctattttttttattaaaccttgggggggggcgggggccccataccccctattaggggggatattacccccccctctggcgcgtgttt

SEQ ID NO: 19908 - DNA, 1661 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaa

SEQ ID NO: 19909 - DNA, 1632 bp, Homo sapiens
cgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaa

SEQ ID NO: 19910 - DNA, 1718 bp, Homo sapiens
ccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaa

SEQ ID NO: 19911 - DNA, 619 bp, Homo sapiens
agtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggac

SEQ ID NO: 19912 - DNA, 665 bp, Homo sapiens
ctggccgcccctttgggcggagaggggacctcaccagtttttttagtatcgcccacgcccagttccctggccgagtccgcagggccctcctagagccaggtgggagtggggagcgacccgcagctgctcactccaccttgcgcggcccatactgggcgtgtgcatctgaatcccgctggagagcaaacacgaacttctgttccctgcaaaatggttagaaagaaacagctggattacgttcctctaaaaaccacctgaacgtaaccttcgcagggcgtcaagtcatcttttcttgccttcggttgtggcttctgtggctttcccgatttgcacatgtcctggggtactatgaacgtgagtggggtattttgttctggcattaaaagaaaaacaagcaagcaaacaaaaacacagcctccgatgccaaacatgttcccccttcttcacttccttggaactggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactaaaaaacat

SEQ ID NO: 19913 - DNA, 648 bp, Homo sapiens
taacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtaagccagctagataa

SEQ ID NO: 19914 - DNA, 466 bp, Homo sapiens
ctgatggtcagcgtttaccgggtccatgttgacactatgtagcttgctactgtgccccaagaagggcacaagctcgttactgtgttgttcttgccagaattgcataacctcaatctagtaatgaggaaatactagacaaacccaaatggaagtttctgtaaaacaactgaccagtggggaaacaaagactggccacacttagagaatggaggagaccaaagagatgtgacaggcaggatcctgggccaagaaaagagcatcggtgaagttgaagtttcacttcaaacttgtgaagtttcagtaaggcctgttgatgaattaatagtaatatgtccatgttagtttcaataattatacagttatgtaaggtgttaacattaggggaagctggataaagggcatataggaactctgtgtactcattttgtaacccttttgttagtgtaaaattattttttaaaagtct

SEQ ID NO: 19915 - DNA, 404 bp, Homo sapiens
tacttttgaatattttatcaacatttttatccaaaagaataagggcagaatcatcaagtaaggcatggaagaggacagggaggacatagaaaaaataggcagtgtcaaaatcagactctgaaaaccagcagcccaataactgaacctatagacatgtactgtttggccagcacagtagtggcccacttgttgattttaattttttaagttattggctgatatgtacaaatcagggtttttcataggaactcagatttctaatttgtagttaaaatgttgtagtgtactccaggtatctggcaatgctgagccaccttttcccagtccctgatcagcgggattccctggagaaggagcctctcactccccacatacattctccttctgaaatgtacagtacctcc

SEQ ID NO: 19916 - DNA, 203 bp, Homo sapiens
agaaatcactcactatcatgagaacagcagcctgggggtaactgctcccatgattcatttacctccccactgagttcctcccacaacatgtggggattatggcaactaaaattaaagacgagatttgggtggggatatagccaaacaatatcaatgtccaaaagactaggaaaggataggaaatgaaaaagtaatctataatc

SEQ ID NO: 19917 - DNA, 432 bp, Homo sapiens
tgtcctgaaatggttaattcactgtccaaaaatagctttcagaatgcattagaagtaataaatagagtaagcttaagaaacacttgagtatgacaaattagcaagctatattaactcaattcaggtaatatcagtaaatctcatacaatttaagaatgacagcccaggcagtagctggacagaaatggccttggtgaaattaagaacaagggcataagtgacacaagaaagctctgggaagatatttcagatggtattttagtgggttgaatctgggatgggatagggaagggataaggaatgacatgggatggtcagttggccattacattcagtctccagggatgtttgccatttctcataggcaaagctattcccgaaggtatattgattatgatttttttttcagattgggtttggagaggccgtgtg

SEQ ID NO: 19918 - DNA, 647 bp, Homo sapiens
cgatggagcttccgaggggaaacggctgggtatcttataagtcctgagggccttcactccccaccatgtcttttgtacattttttttttccttttagagacaggatgtcactctgctgcctaggctggagtatagtggtgggatcatagctcactgcaagctcgacctcctggattcaagtgaacttactgccttgacctcccaaatagctgggactacaggcgtgcaccaccatgctcggctaatttttaaaatgtttatggagatggggtcttgctctgttgctcaggcttgtctcaaactcctggcctcagatgatcctcctgcttttgggtcccaaagtgctgggattgcagatgtggctcaccacgcccagcctgaacatcgtctttcttaggtgacttcctccacatagttatttgtgaattgtaatattgtgtggcaatattatccaaaaagtatttgtttttattgtattttgcaatccctaggacatattaaatagctcaagtgatgggatgttcttcttaaaattcgatctcatagtctaaaatggtgacttgcacatgagttagcctcattaagtcctggacgaatggcaaatgctataatttcctgtctcacttctggatatcacagtgtcatct

SEQ ID NO: 19919 - DNA, 197 bp, Homo sapiens
gttagggaggcactgatccagtgaagtcctcagatcaaccttgtgagctttttacaagtacctgtcactgttaaactgctgatgaaatgtgaaacgacttcacaggttttcagtctgataagctctcctgtgtcactgtcccttaccttgttagtaaaggtcaatggttctcaaagttccgggcacatcccctgggg

SEQ ID NO: 19920 - DNA, 261 bp, Homo sapiens
caggagttgaagaccaatctgggcagtgtagcaagacccctgcctctacaaaaaattttaaaattagctgggcatggtggtgcatgcctatagtcccagctactcaagaggctacagtgggagaattgcttgagcccaaaaggtcaaagctgcagtgagccacgattgcaccactgcaaaaaaagaaaaaagaaaaagcaggccgggcgcattggctcacgtctgtaatcccagcacttgggaggctaatcacgaggtcag

SEQ ID NO: 19921 - DNA, 423 bp, Homo sapiens
gactgagaaggggcacaagggtatctcctggagtgacagaaacattctatatcttcatctgggtggttacacagttgtgtgtgtataacaagttattaaaatacagactttggagtcatgcattttactgtgattacacctcagtaaaaatcgttttaaatacccaagagctatgacttctcatcaataacttaggctcactagttatcctgattctagtgcttcctagatgtataaccacggcagactagcaactgaactattctgtgctactcttattacctatgttttaaagaacagtagcatagagcagttcaattacttgtctcccagcgttaccaggattacacctcagggcatgctgggaaggttatatgagaagtgtatgcggcatttcaaagtgtcaggcacacgatgaatgct

SEQ ID NO: 19922 - DNA, 447 bp, Homo sapiens
acacttcctaggagttgaaggatgcaaagcaactcagtcaacattccctgtcctcaagaaattgacaatccaataaatttcctagaacagcagttctcaaccagaggtgggcaactgttccccagggcatttttggttgtcacggctggacctgagggaaggggctgctactggcatctaatgggtagacgccaggaatgctgttaagcatcctacaatgcacacggcacacctcccacaacaaagaattattcagtccaaaatgttaataggtttgtggttgagaaattctctcctagaatgatcacaactagaacacgaaaatgtccgcaactaggatggatctcttgtatctttccaatggagcatcaaaaacatatgtcctaaggatctccttattcccagagcccagaattcgcccatgagtttcccttaattccaccatcc

SEQ ID NO: 19923 - DNA, 377 bp, Homo sapiens
atggactaggaagtctgccttggaaattagggcttattctttgaaaaaccacagatgtatttattatttgagacaaatgtgtagtatgggatcttttctccctccgataatattaaatgctgtgttctcacttgtaagtgggagccaaacaatggttacacatggacatacatagggaaataatagacactggggactctaaaagcggggagagtgagaagaggatgaagattgaaaaattgcctattgagtacaatcttcactattatggttacaggtatgctagaagcccaaacctcaccatcacacaatatatctatgtaacagacctacacatgtaccctctgaatcaataaaaataatatgaaatgctgtat

SEQ ID NO: 19924 - DNA, 336 bp, Homo sapiens
gtggaagggaggctgtatgcatatagaatgttattattggaactttattattgtcacattgatgttacatttctcaggaaatatatgctaatgtgtttctacttgctttttttaaggccttgagtagatgtgctgaatattgaagctatttggctgcctagaaaatatatcttacaatttataagctgtatgttattatttaaaaaaaaaatcaataatctcccagaattttgcatgaataatatagagatagaaacttaggtgatttacgtcttgtggtattcagtttttaagatacgtacagatgacataccaggcaaccaataaaaaactata

SEQ ID NO: 19925 - DNA, 597 bp, Homo sapiens
caggatttctggcctctctagtgtgagcagctgctctgtcctcaaaatctcattggccccctactgcctcctcctaaaggatgctctcaagtacctccccaacatgtagggccaggtctgaaagggccttgatcctcggctgctggtgacttttcaaagcaactgtctttccctccttaccttgcccgtggtccgttgtgccctttctttgctccttctgcctaatgcagtagtcacaagacaagggagctttctgtcaactggcaggacttgagcacaagcagctgtgtgccgtggggaggaaatcttgtgttattacacacccaggacctctgagtccacacagcttatcgtataccttatccacacctctggctccactggtttttgtttttgtttagaacatttccttctccctaaatctgccttggatcctaggcccttttttgcagtagtgcctgatctcctgactcaaaaacccattttatgcaagggaaatggttgcagatttaggaaaccgctttaaaaaacagttaactaaaaatttcaaggtgcctaaaaatctaaaataaaatcaaatatttttgtccagcaatc

SEQ ID NO: 19926 - DNA, 244 bp, Homo sapiens
tgcctcaccctccccagtagctgggactactggcatccaccaccaagctcgactaacttttttttgtatttttagtagagacagggtttcgccgtgttggccgggctggtcttgaactcctgacctcaggtgatctgcccaccttggtctcaaagtcctgggattataggcgtgagccacccagcccatgccctgcaaattttaaaatgctgcatgttttacaggaaagggtctggccccggga

SEQ ID NO: 19927 - DNA, 341 bp, Homo sapiens
cgtgccaccctgcccagctaatttttgtatttttatgtagagatgcggtcacactatatttcctatgctactcttaaaatcctggtctcaagtgatcctcctgcctcgggctcccgaagcactaggattacaggtgtgagccactgtgcctcaggcctttacagtatccacttttaaaaattacatttggaagctgggcatagtggcacatgcctgtattcccaactactcaggaggaaggatcgcatcagcccaggagttcaagggtattgtgagtgataattgtgcctgtgaatagcccctgcactcctgcctgggcaacatagcaggaccctatgttt

SEQ ID NO: 19928 - DNA, 421 bp, Homo sapiens
gcatgttttaaaaaggctggaacctcttctcttttcaacaaagaaaaatttattgtagccacatgagccaaacacatgataaggaacttatgtgcaaagaaatgatttgggccatatatccttcagtggaaactttaagagcatctaatcacctacatattttagttaaatcatagtaaacatcaagcatctgcatatttgagagatgcaaacatgctgagttttgtatttttgtctgagtatttggagtcacacaggttcatttcaatgactgaatacagagctatacctaagaagccctcataactggtcaagaatgactctagctcttcattctcaccacccgtattccccggaaaatttccatattgttcagatctccacgaagccaattctcttatttgaggaaggtatatttccc

SEQ ID NO: 19929 - DNA, 363 bp, Homo sapiens
gtgtcccccaggcctcctgacagggcaggtgtagatggagtgtggcgacctggccactctgggctttccaccactcatggtgcttgtaatccagtgacatcaggattgaaaaaatagggccaggcacggtggcttatgcctataattccagcactctgggaggccgaggtgggtgcatcacttgaggtcaggagtttgagactaccctgcaacatgctatctctactaaatgtacaaaaattagccagatttggtggtgagcgcctgtaaccccagctactcgggaggctgaggtgggaggatcgcttgaacccgggaggcggaagttgcagtgagccaagatcgcaccactgcactccagcc

SEQ ID NO: 19930 - DNA, 615 bp, Homo sapiens
taattcacaacattttcatcactccaaaaagaaaccctatacccgataagtagtcactgtaagttcttttttagttcattatatcaggactgctggtatgccatgtgatgactcaattttctcaccatttttctgcattcaaggcactgagaaactcactgataatgtaatttcgctttcacttggtaggatgcgtcatttacatattaggttcacctctgctcctttttatttagtcctcaacgattaaattataactacttgacactagtacacccctaaacaggaatgtgaaaaccaaacatgatgcagtactagatatgaaggtgatcagccagatgattccgaatacccttatattaactttttaacagtcataagaatgaaaatacatcattaaaaaaaaaatgtcatagagaactcatggagcactgagactatctcaagatcccagattgagaaacgttatttatgattcttgagtttttatgtgtgctgtttaatgagaatgaggagcctgggcattttaaatctcttattatacttttaaatgtttagaataattgcccttctgtctgaaaattatctttttgggaaagtcttattcatatctca

SEQ ID NO: 19931 - DNA, 283 bp, Homo sapiens
ttcccagaaaataaggaaatgctcaaaaaagggtatagatatatagaaaggacaccagacccaaccgaagcagctcccagtggctgaagctgaaacaatttgaacaataaaattagtgacagtgtgggattatcacctagagaataaaataaatatccaaactgctataagtaattgaataaatacctaaatggagggagaagggacagatcttccttacagatgagtcacactacactctagcctgagcaatacagcaagactccatcttcaacaaccaaaa

SEQ ID NO: 19932 - DNA, 366 bp, Homo sapiens
tttgacggagtctcgctctgttgcccaggctggagtgcagtggcatgatctccgctcactgcaagctccacctcccgggttcaggccattctcctgcctcagcctcctgagtagttgggactaccagcgtccaccaccacgcctggctaattttttgtatttttagtagagacggggtttcacagtgttaaccaggatggtcgcgatttcctgacctcgtgatccacccgcctcagcctcccaaagtgctgggattacaggcgtgagccactgtgcctggccaatgacaaaccagcttcttaagtgatcataaaccagcaccaggcagattaaagacaaaatgggcagattctgtacttaaaagca

SEQ ID NO: 19933 - DNA, 551 bp, Homo sapiens
cacggtgtcttggaaaatggaaagaattgggagccttcctaccgctggtgaaatctaggagtggcagttgagggcttctgttcacaaagtctggccatgtttctgtagggctgctgtactttgctgggcttcttctccagttcctagtctccttggattttccagtacctggagctatcaccagtgaaggctgtgaaacagcaaagatgtcagcctgcctcttcctctgggagctccggcccagcgaggcacagacctgttgccagcccaaatgcgcctgcaggacaaggctggagaccctggttgggaggtctcacccagtcaggaggaacgggatcagggaactgcttaaagaagcagtctgtccatgctttcacagatcagctgtgctgtgctggggcactgcttccacccctggttggtgtgggctccccaaagcctggaggccggaacagctaagtcgcccaaacagcaaagatggtggcccctccctctccgggagctctgtcccagggagaattcaaatctctgtcagccagagaacaccagta

SEQ ID NO: 19934 - DNA, 426 bp, Homo sapiens
gcaatagtaaatccttccctatcagtaattactttaaatgtaaatggtttaaattccccaatcaaaagacataaagtggatgaatggattcaaaaaagcaagatccagcaatgtgttgtctataagagattcactttaaatttaaggacacatataggctgaaagtaaaaggatagaaaaagatattctgtgcaaatggtaactaaaccagaaaagggtggctatagttatatcagacaagataggctttaagtaagaaactgtcacaagagacaaagaaagatgccatataatgatgaaagggtcaatccacccaaaatatataacaattataaatatatatgcacccaacattagagcacctaaatatataaagtaagcattgacagaactgaagggagacacagacagcaatacttaatagta

SEQ ID NO: 19935 - DNA, 902 bp, Homo sapiens
ggatattgaatgttcctaacacaaagaaatgataaatgtttgagatggtggatgtactaattgccctgatctgatgactatacattatatatattgaaacatcagtatgtaccccatgaatatgtacaattatatgtcaacttaaacacatttaaaagtaaaaaaaaaaaaatccaaaacacgcaaggaactgagccagcacgaataagaattagcaaaatcttcaaacctcaagaccagactcacaaggacttcagatacagaaattttaaataaaaattataaaatgagtatgttaaaatgtttaaagaaataaaggaaggcattggtatatgatacagaaataaaagaccatcaaaaataatttggatgacatgaaaacaatcaaatagacattctggaaataaaacatatataatggacaggagtgaatgtccctaggctcctgacctctctgcatttgcaagtagtctgagccagaaaacgctgaaagacctcagaagccaagtggaagccccacagtgaagccaggagggccttcatttcagactcagcagctgcccacggtggtggctgacacactgctgtagcatgtgtgctgcctgaacactcactggccacccccacagcccagagcactggcatcatctgtactatcggcctagtttcctgattggtggaaatgttgatgattaagtctggaattaatatggcttgtctgaacttacgagtaccacgcagagaccatcaggaatgtgtgcacaactatggaaagccttgcttctgaccccaatctctagcggctagttgctgtggctctggacactaacgggcctgagatctgaactgggctcacacagagcagtgtccccatggaggtggagctgaagaagggagccacc

SEQ ID NO: 19936 - DNA, 436 bp, Homo sapiens
aaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaagggtaatatatgcacctttcagaaatttgtgttcgagtaagtaaagcatattagaataatt

SEQ ID NO: 19937 - DNA, 1843 bp, Homo sapiens
gaatttagtactatttatgtagtcctcagttgtgatgggcagacagttgaaccttgtacaccatatttagaaaaaaaacacaaaaaaccttttggccaggcgtggtggctcatgcctataatcccagcactttgggaggccaaggtgggcagatcacctgaggtcaggagaacatgacgaaacctcgtctctactaaaaatacgaaaattagccaggcgtggtggcagatgcctgtaatcccagctcctagggaggctgaggcaggggaatcgtttgaacctcagaggtggaggctgcagtgagccaagatctcaccactgcactccagcatggatgcccagcctggatgacagagcaagactccatctcaaaaacaaacaaccaacctactttttgtataggtatagtttgaacctagtattcagaccagtaaaatgaaaaccttgcagtaaatgcttcccagtctttattgggctaaaataggccacgtgtgcttttagaaagatggccgcataataacatgtttattgaatgcctttttacctaacatgcaggttctactttattttcccactttgtacaagacaagcagtttttgttcttataagtagtgaggaagtcaatatagtagatttacgacattgcattttcaagccactgggtgtaaaaataaaattactcaaaatatgtaaaaccactgaaaacaatgatttaattgaaccagtcaaacattatttaaaattgagagctggtgtcccatccaggtaggccacttttaaaagacagattttaagtttagtctttaaagttttcaggctgtaccatgttgtccttccattagatgtctgaaaacttgaaaaactgccgtatcatctcacagtgatgcttttttgtggtgtgggcagggaatttcaggcacacttttgccaatcccacaccagggaaagctatagtctttggttgcctgtggttaaggaattgagttaaaagtttcctttttatctcagggatttgcaggagttatttattcattcatcagatatttacttaactcttaactcatgccagaggcacttgaagatacctgattcctgtcctcaggaagtttagagttgagatgtggggaaacggagaagtaaataagtacagcagagggctaaaagtgctgttttaatagaagtttgcacaacccaaaggagacagaggtctatataggtccatcatgggaatcagaggttgaggatgcccaggttgatgaagcttaaattgagcttcccctttagaagagagctgccaccagtaaagacacagaagtgcaagacattaaaaagctattctagccagtagggtagagtagaagcaaggactttgtggtcagatgtgggtttgtttctggctagtggtttgtaacccctaggcaagttacttaatcttgctaagtaaaccttagtttcctcatctgtaaagccaggatgataataacacctccctcaaagttgttaattcattttgcaattcacgtgttgagtactttttaagggactgggaatacagcaatgaacagcacaggtctgaatgaggaaggtaggaccgggtcacgaaggtatgccaccagttaacaaagacactctcaaaacaggaaggatggcaagtcgttaaaataacatccagggctccatttttacctgaagaagaatagatgataagaattattttaggtgattaggttaagaatgagtttgcgctggtccgagtgcagtggtgtttacaactaattgatcacaactagttacagattatttgttccttctccactctcactgcttcacttgactagcttta

SEQ ID NO: 19938 - DNA, 1726 bp, Homo sapiens
aaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctcttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaatgtacactgaagtacaagat

SEQ ID NO: 19939 - DNA, 395 bp, Homo sapiens
tatatagaaaatgtttctcacaaggttgctgtatttaggtttgtgccttattgcaaatgctatcatgtttacacataaaaatggaatatgggccgggtgtggtggctcacgcctgtaatcccaacactttgggaggcccaggcaggtggatcatgaggtcaggagatcgagaccatcctggccaatgtggtgaaaccccgtctctactaaaaatacaaaaattagctgggtgtggtggcacatgcctgtagtctcagctactcaggaggctgaagcaggagaatcgcttgaacccgggaggtggaggttgcagtgaaccaagatcgcaccactgcattccaggctgggtgaccaagtgagactccgtcttgaaaaaaaaaaacatggaatatgta

SEQ ID NO: 19940 - DNA, 207 bp, Homo sapiens
ctgactattgccacttagcagatatcagattccccatgtttgtaccacttaattacaaagaccaattgatgagagcaaaacaatagtttctactagcaaagggagtagagtgagtacgcagaaataagaatcaggacaaaaccagattgggccaggaaccagattcagttcacacaatttaagaattatctgctgaatggagaaact

SEQ ID NO: 19941 - DNA, 526 bp, Homo sapiens
gaaaattttatattctataaaaatatttttcaaatctcttcctgacatttattggagaagattaaagtctttaatcctcaagctaatttctatgtggtcctcataaaattccactataattccattatcgggaggctggccatagaggaaacttgagtcttcaacctaatgtaaaaatctgcctttagacagatgtgtagatttttcttaatgtcaaaaactagttaccggtaggccaggtgcagtggctcacacctgtaatccctcctgcactttgggaggccaagatgggcagatcacttgaggtcaggagttcgagaccagcctagctaacatggtaaaaccctgtctggactaaaaatacaaaaattagccaggtgtggtggcagatgcctgtagtcccagctactcaggaggctgaggcaggagaattgcttgaacccgggaggtggaggttgcagtgagccgagatcacaccactgcacactgcactccagcctgggtgacagagcaagactccgtttca

SEQ ID NO: 19942 - DNA, 482 bp, Homo sapiens
gcacagtgtatctccaagtacagctcgtaggccctgggtggcagcaactgcaggttcccaggccccaaccaggacgtgctgattctgagtctcagtggacaaggcctgggaatcggcatttttagccagtctctccaggtgattctcgcaactcatgtgataccacatcccggaatccgcggctgactatacgtgcttggtttggtgggcgccgtgttgatcttctgtttttagagtgagactttctacattgtctcctgccaggtgggtggatccaaataccccagcccacgaggtttccagaaatggaatttctcccggtgctttcagtgtttttcttttaaaattaacattcaattctggcaggacacagtggctcacacctgtaatcccaacactttaggaggccgaggcaggaggattgtttgaacccaagagtttcagaccagcctgggcaccacaggaagaccctgtctcaatga

SEQ ID NO: 19943 - DNA, 1280 bp, Homo sapiens
  misc_feature (1260)..(1260): n is a, c, g, or t
catgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgattctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaaaacctgcagcccgggaaatccnctgggtcttcagtacgcagt

SEQ ID NO: 19944 - DNA, 1787 bp, Homo sapiens
catgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgattctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaactctctagtacattgtgttgtccctaaactgatgggctaggaattgtgtctcattatggcttagtctttgtgggttttccccagtgagttgagagtggagatagacctagtaggatgattatattcaggtcagagaccagctcctctcaagagagttctttccacagatggaaaagatacgttaaaattgccaaataaattaggaaatacttggcagaacctggaagagcctccagactggcgttacata

SEQ ID NO: 19945 - DNA, 1536 bp, Homo sapiens
catgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgattctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcagga

SEQ ID NO: 19946 - DNA, 1758 bp, Homo sapiens
catgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgattctgaaactgaggcaggttcaggtttggggtcactgattctaagacatttacagaagttcgtgcatgtgtttcagccatgatccccaagattgaggctattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaactctctagtacattgtgttgtccctaaactgatgggctaggaattgtgtctcattatggcttagtctttgtgggttttccccagtgagttgagagtggagatagacctagtaggatgattatattcaggtcagagaccagctcctctcaagagagttctttccacagatggaaaagatacgttaaaattgccaaataaattaggaaatacttggcagaacctggaagagcctccagactggcgttacata

SEQ ID NO: 19947 - DNA, 1754 bp, Homo sapiens
catgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgattctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaactctctagtacattgtgttgtccctaaactgatgggctaggaattgtgtctcattatggcttagtctttgtgggttttccccagtgagttgagagtggagatagacctagtaggatgattatattcaggtcagagaccagctcctctcaagagagttctttccacagatggaaaagatacgttaaaattgccaaataaattaggaaatacttggcagaacctggaagagcctccagactggcgttacata

SEQ ID NO: 19948 - DNA, 314 bp, Homo sapiens
ctattcataatcagctccatagccatttcagttgtatagtaaaaatggaagctgtaattctccttaatatattttattctgtggttcatcacttccccaggcctccccatctctgcatctttttcctttccttttccttcccactgcagcagaagcacaagagtattcattaatcctgacccctaaaaagcaaacaaaagagagcccacacaaattcatcagttgaagtggaaggcaatttacccagagcaagagcccaccccattgttgccagatgaatggtgctggtagctggagccgaaggaggctgccac

SEQ ID NO: 19949 - DNA, 106 bp, Homo sapiens
agatgagttgtgcgcggtgatggccgcctgtagtcgcggctactcgggaggctgagacgaggagaagatcacttgaggccccacaggtcgaggcttcggtcggccg

SEQ ID NO: 19950 - DNA, 487 bp, Homo sapiens
ctctgaaatcaagctgtgtctgtctgcccaggggctctgagaacatggaaaatagacagagcttagagttattagaaaaataaaagcaaatgaatttgcaaagaaaaaccagtgaggagaaggatttgattcatcttccaagggtccatagctgttaacccaagccattcttgggggatatccagtctcttgagtggctgggactccataccccctttccttctttaataggtctgtcaaaggcagttcccacaaaagctggctaaaaaactgatacccagctccagcgtctgagggttcatgaagatgtggaggtttttttgtttgtttgttttggttttttgttatgtttgtttttgagacaaagtctcaccttgctgcccaggctgagccgggaggattgcttgaacccagaaggcagaggttacagtgaaccgagatcatgccactgcattctagcctgggtgacagagcaagactccatctc

SEQ ID NO: 19951 - DNA, 420 bp, Homo sapiens
gcgcgcgccaccacgcctggctaaggtgtgtgtgtgtgtgtgtgtgtgtgtgtctccaaagtagcgaggactacgggtgtgtgtgtgtgtgtgtgtctccaaagtagcgaggactacaggctcccgccactacgccaggctaaggtagggtgtgtatgtgtgttaactttttgtagagatgggatctccctttgtaacacgggcgcccgccactaagccaggctaaggtggtgaatgtgtgtgtgtgtgtgtgttaactttttgtagagatgggatctcgcttcgtaacccgggctggtatcgaactcctgtcttcaaggaatcctcccgtctggactcctcccatgggattacgggcatgagccacggcacctggctattttttttttctaagcatttaaataagctggggcttgattt

SEQ ID NO: 19952 - DNA, 246 bp, Homo sapiens
atttatttcactcttttttgccaaccttctgtgaggaacttcactgggatattttgtttaatgctccttgaaagcatcggctgccctaaaattgtctttttcagagaaggtctttctttttttttttttttttaagtccttagctctgtagaaagaagggggaaaactcctgctacacctttacattcccttattaccaaaacgaaatatttaccaaaacaatagcacaaaggagttctaggagtt

SEQ ID NO: 19953 - DNA, 212 bp, Homo sapiens
agctctgtgacattggacaacacatttggcctctgtttccttgtctgtaaaatagggataataattgtaccgactttatgtggttattatgggatttaagtgagttgggtgcttaaaactgccacacatacagtaaatacctcagaggttttagcccccaacaaaaaaaacttggagattttctagctagcatatctctagcgtttaaccag

SEQ ID NO: 19954 - DNA, 313 bp, Homo sapiens
agaaaaagaaaaattaactcaaaatgtatcataaacctaaatgtaaaatacaaaagtgtgaacctcctagaagataacttaggagaaaacctagatggccttgggtttggtgatgactttttaaatatgacaccaaaggcatgatccatgaagtaaataattgataagctggatttcactaaaggtaaatatttcttctctgcagatgatagtcaagagattgaaaacacaacccacagactgggagacaatatttgtaaaagatatatctgatttaaaagaaacattatcccaaaatacaaagaatcttaaa

SEQ ID NO: 19955 - DNA, 609 bp, Homo sapiens
tcaattgcaggaggtagagtagtgataacagcatatttcttttgaaatataaaggtgtaaacttctgaaacagtttaaagtcttaggaagtgctctaggtctgtctttgtcttcgaattatattaattacggagagaatagaaagtggtatttctcttaaggctcctctaaatatcttagtaactgtaaagtgattgtcataaaaacatgtcttccttactcaaatctttccagtttcatcaatatctgtacactcaatatatggcatcctctttacaaatggcaccgctggaggctcaacatttaggtatacgtattaggtgtcctagaagcgctccttgttcagcatgtttgtaaggtaaaggagaaataagacatagcaaatatatgcatatggctagaaataccagtggtggagcattttgaaattgaaagtggtctataaaatcctaatccatttttgtgttggggtttagtactagatggtgaagtgaatgtattcttaacccagagataactagagaaatagaagaaaaacctgaaaataagactcatgatacaatgtttgttgaatttgttgaggtcagcagttgttacattagtgtaaaa

SEQ ID NO: 19956 - DNA, 693 bp, Homo sapiens
tcttattcagaaaacacagctgtgaaacaaaaataatgttttaagcaaggacctaattaacctgctgatgagacatatcatctatctctaagccaaacattaggaacttggcacctctactgcccccagcctattcattcttaacacgatttcaaaatgcttttttatttggtttcaagactgcagcaagatggagaatggggaccactggagtcaggcattgttaagaatgagcagcagcagatccgttcatctttcagaacaaagaaaatcaatgagcatcaacactaatccaaacaccgcactttggggccatttagggtagaattaaacagcctgatatacctcgaatgacctaaaagatgtcaccgaattatttttaaaattgattattatcatgacccttaattgctgtggaaggtggcattatgtttagtgtcctgattgtgagtggtataagccactttagaaaggctttttattcaaaattgttattaaaaaaaaaaatctggtgctttaaggtatatgcctccaactatccaatattaaagtgttgttatatgttacttttcgtagttatctaaggggttggtaatagtgagggcttgtgattaatttgtctatatcatcaaaaggatagagggccatgtggtatgatattatcaagaataaaaatcactaacatttaaaaaa

SEQ ID NO: 19957 - DNA, 497 bp, Homo sapiens
caggtccccgcatccgcctgcctttgcacttgggggtgggagagccaccttgtgacgccccttctgcctctcaccagcttccccctttctccccgttctgtacggttccccctggagccagaaggaagcccggtgccagccagccttcctgaaagaccaagcccgcgccatccggcttcctccagtggacgcctgcaggacccaggtgagacacggaaccggttggggacgcgagccagggatcctgaccggttgggggcggcgagcaagggatcctgacttgggggcgttgcctcccggaatccaagcggccttttgcccgggtctcccgagatgcatcgaaattgagctcgtccacacagccccctgactgcgtgatgcccttttctgacttaaaacattccttgtacctttatttacacgatccaagttgcagtgtgcctagattttcctccaaggacaaaaatgtgaataaagcaatattttagccaaacaaa

SEQ ID NO: 19958 - DNA, 1067 bp, Homo sapiens
cgtgaggcgctgctataccccctcgtggggaaggtagaaggtggggtctgccggacgcgtgttcctgccaccaggtgcccgctccccgcgaggccggctcaggagcagaaggaagcccggtgccagccagccttcctgaaagaccaagcccgcgccatccggcttcctccagtggacgcctgcaggacccaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19959 - DNA, 836 bp, Homo sapiens
gaagattgcaattcgttccagactataaattctctttaacaactccctaaggtattcttttaaattgtttttcagcgttgctaaatgtgcatcataatgtgtgggagacttgtataaagtgaatcaatttatactcagctgattaattgacccgatgttaccacctccaaggaggcacctttccactattttctcattttttccccaacacatgttatttgttagtgaggaagctgcgtgcacgtggcattgtataaagtttattagacagacgtggcccttaaactaggaagagcttagtctaactctaaatctaaaattcgacatttcggtaagttgtgagacaagatacccaggttgtttgataaaccagaattgaacataattttttaaaaatttaaatcacaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaattggaacaaagaagtgtaagtccaaggaatcctctcccaccatttccctcgtgcc

SEQ ID NO: 19960 - DNA, 699 bp, Homo sapiens
  misc_feature (18)..(18): n is a, c, g, or t
aaacctttgggccttttnaaaaaaatggtatgggcaaaggtgtgggcggctcacgcatgtaaccctagcactttgggagaacgagttgggcagatcacatgaggtcaggagttgaaaccaccctggccaacatggtgaaacccgtctctacaaaaaatgcaaaaaagttaggcagccgaggtgcaggcaccggtaatcccagctactccggaggctgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19961 - DNA, 1397 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcccttcgtgacttcaaaagtcctgggcactgttgctcatgagtgctgcacaactgtcgccctctaaagccacctccatccctcactgggctggcctcctgagccttcggtgaggaaacggggttccgagttgcccgcctgagagcttaacagtctgactagaaaagggctaattcgctttctgtgcaaatctcttgagctaattatttaatctgaaacatggacaggtaaaggaccattggcgggcgtggggagggaggtgtggaatctttcccacactttttgtcaccttaaagaaaaaaaaaagaca

SEQ ID NO: 19962 - DNA, 2155 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcccttcgtgacttcaaaagtcctgggcactgttgctcatgagtgctgcacaactgtcgccctctaaagccacctccatccctcactgggctggcctcctgagccttcgaaggaagcccggtgccagccagccttcctgaaagaccaagcccgcgccatccggcttcctccagtggacgcctgcaggacccaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19963 - DNA, 1283 bp, Homo sapiens
gaagattgcaattcgttccagactataaattctctttaacaactccctaaggtattcttttaaattgtttttcagcgttgctaaatgtgcatcataatgtgtgggagacttgtataaagtgaatcaatttatactcagctgattaattgacccgatgttaccacctccaaggaggcacctttccactattttctcattttttccccaacacatgttatttgttagtgaggaagctgcgtgcacgtggcattgtataaagtttattagacagacgtggcccttaaactaggaagagcttagtctaactctaaatctaaaattcgacatttcggtaagttgtgagacaagatacccaggttgtttgataaaccagaattgaacataattttttaaaaatttaaatcacaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19964 - DNA, 1012 bp, Homo sapiens
caggtccccgcatccgcctgcctttgcacttgggggtgggagagccaccttgtgacgccccttctgcctctcaccagcttccccctttctccccgttctgtacggttccccctggagccagaaggaagcccggtgccagccagccttcctgaaagaccaagcccgcgccatccggcttcctccagtggacgcctgcaggacccaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19965 - DNA, 1572 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcccttcgtgacttcaaaagtcctgggcactgttgctcatgagtgctgcacaactgtcgccctctaaagccacctccatccctcactgggctggcctcctgagccttcgaaggaagcccggtgccagccagccttcctgaaagaccaagcccgcgccatccggcttcctccagtggacgcctgcaggacccaggtgagacacggaaccggttggggacgcgagccagggatcctgaccggttgggggcggcgagcaagggatcctgacttgggggcgttgcctcccggaatccaagcggccttttgcccgggtctcccgagatgcatcgaaattgagctcgtccacacagccccctgactgcgtgatgcccttttctgacttaaaacattccttgtacctttatttacacgatccaagttgcagtgtgcctagattttcctccaaggacaaaaatgtgaataaagcaatattttagccaaacaaa

SEQ ID NO: 19966 - DNA, 1096 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccagcttgggggcccgggggggaccgacaggcgaacggagccccgggcgccgggcgggccc

SEQ ID NO: 19967 - DNA, 1708 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcccttcgtgacttcaaaagtcctgggcactgttgctcatgagtgctgcacaactgtcgccctctaaagccacctccatccctcactgggctggcctcctgagccttcgaaggaagcccggtgccagccagccttcctgaaagaccaagcccgcgccatccggcttcctccagtggacgcctgcaggacccaggaatgtttttcttgaaggcatccagcatctccagttagcagtactgattttttttccccccaacaaaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaattggaacaaagaagtgtaagtccaaggaatcctctcccaccatttccctcgtgcc

SEQ ID NO: 19968 - DNA, 1106 bp, Homo sapiens
cgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggtgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgcccagggtaagtctgggactgccgttcgggcctacccagcaggtaagtcttaggccatcgcctgcggtgtcggccccgggagcagcgagacccaagattgcatcaaacgtttgccccgtctctgcatatgtgactggacgtgaatgatgcttcattttggcaccccctttccctgctcaggtagaatgtaaacaattgaaaaaaatcccttcccaatcagaataccacccacaggacaacgaagaaaacgagtaaggggagaggaagggtgagcagctgcaagaagtctttacacctctctgcggttcctggtaaacgcgctcatgtcctgggtatggaagggacttaagaattcaggaaagatcaaaataacgggcctcttccccactccctcgccctcccttccccgctgctggggggttagggaggctccgtggagctccagcactctagaaggatcgggtgaggcgcgaggccttgcgggcgggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgccccaggggcgggacctgagctgtcggtttcaggagcctcgggaatcgccgggccgggccatagtgtgccactgggctctaagcacacacctgggggcacgactcgg

SEQ ID NO: 19969 - DNA, 999 bp, Homo sapiens
cgtgaggcgctgctataccccctcgtggggaaggtagaaggtggggtctgccggacgcgtgttcctgccaccaggtgcccgctccccgcgaggccggctcaggagcagaaggaagcccggtgccagccagccttcctgaaagaccaagcccgcgccatccggcttcctccagtggacgcctgcaggacccaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaaggactctgcagtgcaaattgttttgctgattgttttaaaacaccatacctatcaactcatcaaggcaaatggggcagcgggggactgggttcgttccctgaatcctggactgctatagagctcagggcaacatttgcagaaaacctgagcctatgagatgggagttataggcagctttcctgaggctgtgtaagatgaaaataaaactaggttca

SEQ ID NO: 19970 - DNA, 689 bp, Homo sapiens
cgtgaggcgctgctataccccctcgtggggaaggtagaaggtggggtctgccggacgcgtgttcctgccaccaggtgcccgctccccgcgaggccggctcaggagcaggtagaatgtaaacaattgaaaaaaatcccttcccaatcagaataccacccacaggacaacgaagaaaacctatcttcagtccccacccacgaaatgctggggggtggggaggactggaaaaggagtaaggggagaggaagggtgagcagctgcaagaagtctttacacctctctgcggttcctggtaaacgcgctcatgtcctggaaggaagcccggtgccagccagccttcctgaaagaccaagcccgcgccatccggcttcctccagtggacgcctgcaggacccaggtgagacacggaaccggttggggacgcgagccagggatcctgaccggttgggggcggcgagcaagggatcctgacttgggggcgttgcctcccggaatccaagcggccttttgcccgggtctcccgagatgcatcgaaattgagctcgtccacacagccccctgactgcgtgatgcccttttctgacttaaaacattccttgtacctttatttacacgatccaagttgcagtgtgcctagattttcctccaaggacaaaaatgtgaataaagcaatattttagccaaacaaa

SEQ ID NO: 19971 - DNA, 1608 bp, Homo sapiens
ttgccctgcccagtaatggcctggaagcagcagcctctcactctggcctggtaggcagcgatgctgagactgaagagccaggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtct

SEQ ID NO: 19972 - DNA, 1328 bp, Homo sapiens
ttgccctgcccagtaatggcctggaagcagcagcctctcactctggcctggtaggcagcgatgctgagactgaagagccaggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtagcaattgaccggggatactcaagatcagcccgg

SEQ ID NO: 19973 - DNA, 528 bp, Homo sapiens
ccacggaagaggatcaggattaattatgtctgtgaggaagaagaaaagcaaatagctcacttgattaaatacattacaataatcactacattctgtcctttagacctgtgctgtccaatagggtagccaccagaccttatggtcactgagcacctaaaatgtgctcctagtacaactgagagactgaattttaaattttacttaattttttaacagttaaatttaaatttaaaagctgattctcagctcaattattggaaaatgttaagtacgcttggaataatttgggtatatacacctatttttttcaattatgaattttatgacatctaaatatagatcacctatttctggtaaaatttagcatctgaattgagatatattgtaggtataaaacacacactggacttcaaagacttagtataaaaaaggaatgtaaaatatctcaataatgtttatattgatgatgtgtcaaaatgataatcttttgtatgtattgggttaaataaaacatattattaaaatgaa

SEQ ID NO: 19974 - DNA, 219 bp, Homo sapiens
aaaatatttttgacaggagccttaataattccacagagaaggagcaggaagtattatcgtaaatttttagcaaaaacgcaaaacttcacagggaacaagaacaaacaaaattacttgggggtaaatgaatgttaaacgatgatgaattcccaagtatatgactgaagcattcataagtttagtgtagaaatttggaccataaacttaaaggccagatgt

SEQ ID NO: 19975 - DNA, 432 bp, Homo sapiens
tgccaggagacactgcattctactcccaggtgggtttctccggcttttaaaaatgcggaatactctctccatcgtgtcgcagggcatgatttctccattcagtgccttctgaaattgcgagtcagagatctggttccgtcgtccgcttccgccagccttggccaagtcattttgtcttttgatgttgggagggacagaggagttccaaggtcctggatctgactgacttaaaaaggggggtgtcatttactgaaatggcaggaggaggagtgggtttgaaagaagcagagaggaagggaggcagccgtggtttggaaatgttagaaaagggcattgtggccgggcacggtggctcacacctctaatcccagcactgtgggaggccgaggctggagaatcacttgaggccagggagtttaagaccagcctggg

SEQ ID NO: 19976 - DNA, 544 bp, Homo sapiens
tcccttccacagctaatctttactgtcatttttctttgaaattgtcttttgatgttgggagggacagaggagttccaaggtcctggatctgactgacttaaaaaggggggtgtcatttactgaaatggcaggaggaggagtgggtttgaaagaagctgtggaagggagggaatactctctccatcgtgtcgcagggcatgatttctccattcagtgccttctgaaattgcgagtcagagatctggttccgtcgtccgcttccgccagccttggccaagtcattttgtcttttgatgttgggagggacagaggagttccaaggtcctggatctgactgacttaaaaaggggggtgtcatttactgaaatggcaggaggaggagtgggtttgaaagaagcagagaggaagggaggcagccgtggtttggaaatgttagaaaagggcattgtggccgggcacggtggctcacacctctaatcccagcactgtgggaggccgaggctggagaatcacttgaggccagggagtttaagaccagcctggg

SEQ ID NO: 19977 - DNA, 250 bp, Homo sapiens
ttgagtgtgagttctgattgtgcgtgtgtgtgagttgtgtgtgtgtaagcgtgcagtcctcgcctccccaacagacacctgtcttcactagtgggccccccttgcctctagttgggagtggggtggtccaggcagggtcctcggcgcccttagatggagccgttgcagctgctttttgagttgccctcggcggtgccagtgagcaaggctctgccttcctccgtttgtgccctgggagcccagggcatgg

SEQ ID NO: 19978 - DNA, 344 bp, Homo sapiens
  misc_feature (50)..(50): n is a, c, g, or t
  misc_feature (52)..(52): n is a, c, g, or t
  misc_feature (97)..(97): n is a, c, g, or t
  misc_feature (100)..(100): n is a, c, g, or t
  misc_feature (102)..(102): n is a, c, g, or t
gggtactctagcggatccttcagaggcacaaggaggagaatgggggatantntgtatgaacatgagggtgtttctcgtgtgaatgagggtttatgtngtnantgtggtgggtgagtgagcccattgtgttgtgtgtgtgtaagcgtgcagtcctcgcctccccaacagacacctgtcttcactagtgggccccccttgcctctagttgggagtggggtggtccaggcagggtcctcggcgcccttagatggagccgttgcagctgctttttgagttgccctcggcggtgccagtgagcaaggctctgccttcctccgtttgtgccctgggagcccagggcatgg

SEQ ID NO: 19979 - DNA, 385 bp, Homo sapiens
ccaccatgcccggccaacacttttggctaaggagaagtaatacagtatgttaaaagttggtggtttatttctctcttggttttatgttttgtcctgttcaaaatttagctataggccagcccggtggctcacgccagcaatcccagcactttgggagactgaggcgggtggatcacttgaggccaggagtttgagaccagcctggccaacatggccaaaccccgtctttatgatacaaaaattagccaggtgtggtggtgcacacctataatcccagctacttaggaggctgagacatgagaatcacttgaacccgggaggccgagcttgcagtgagccgagattgcactactgcactccagcctgggtgacagagtgagactct

SEQ ID NO: 19980 - DNA, 590 bp, Homo sapiens
gagatggagtcttgctctgttgcctaggctggaatgcaagggcgtgatcttggctcactgcaacctccacctcccgggttcaagtcaccctcctgcctcagcctcccaggtagctgggattacaggcatgcaccaccacacccggctaattttttcgtatttttagtagagatggggtttcaccatgatggccaggctggtctcaaactcctgacctcaagtgatcctcccgcttcagcctctcaaagtgctgggattacagacgtgagccactgcgcccagcccagaatgatctttctaaaatacaattttgatggtgtcattcctatgcttgaaaacatgtaatggcttactactgccaacagtggtggttcttaaattatgcacctggggatttttgttgttctgagcattagacaaaggtgtttagggcagctaaaatcaagcagagtgtaatgtcaataaggtcaatcactggaacaaaaaacaattaagagatagatatagctatatcttttcccctatgtgttttataaatatttcagacttgttatagtatgtctattaaatagacttaataggtatcaaaa

SEQ ID NO: 19981 - DNA, 378 bp, Homo sapiens
agatgaaagaacgacagaatgagggattttcaggcacgggggaaggaagggtggttttggggaacagaccgtagctgactggtggggggccggctttggaaatactttgaggggatcctgagattggactctagactctcccctggttcttcccttccctgagttctggccggttcttggaccagacaaggcaaggcccaagaatgtagatcagaattttttagcctttttttcattagttccttccctagtattcttctagatttttttttttcttaatcacatgaaattttaataccgcagatgtactatatatctgtttatgttctgtatatgttctgtgctttatacataaaaaagagtaagatttttttttca

SEQ ID NO: 19982 - DNA, 439 bp, Homo sapiens
ggtgttgggccgcatcgacgccagcaggaaggtggacctcagattcactgagagccctgggcggcagagggagggggattggaaccagcctccccgtgccctgctggtgccatccccagcaaaccccccgcccctgagccggaaaacgacccggtggctcctcacctggctcaggcactttcctcaagcccgacactatggcgcagaagttggtgttgctacagtcctgctcctgggaggggctccaagtgcaaggggttctgagtgggggagtctctgaagagggaactcagctggggtactctaagcaggaggttcccagtggcaggaggcatctggcatctgggaaatggggtggagggttctcgccgccactggccctgccgattcaggcattcccaccgccctatcctcctacagatcctatagaccctagaga

SEQ ID NO: 19983 - DNA, 243 bp, Homo sapiens
gtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttt

SEQ ID NO: 19984 - DNA, 472 bp, Homo sapiens
tctggttagtgtttaccagttcaaataatcacatgatcttacattggatatatataaacttacccatatggtgaagtcttttaggagacgatcatgttaaatgtttctcactgtggcttatttaatgtcatcagtttattgcgtgttactttggatgccccttagaacttggcaccaagacctaccctcttagaataaacctggtcaaaaggatgttgggatggttgctattttatctttagaaatgacctattttgagatgtaataaatgtgtctcaggagactggagaaatgcccaaacctaaaggtgatacttcaggacaagaattaagttgcaatgtgttcattattatatatgctttagattgtttctttgaaggatgttttacattagggcagtgccttcctttttagaggaagggaaatttgataataagttagtgtatgtccactaccatttgggaaaaagaaa

SEQ ID NO: 19985 - DNA, 426 bp, Homo sapiens
tggatagtggacagctggatggatggatagatgatgcctaaactcagcatggaaaatgaaagtcgaatatggatgtgtagtcagggtcagttactagactagatttatagaaaacagccactcacatttggctagagcaagagacccacagtttagggaatctgtggtgagaagttgaggagttaggccagagatgatgctaggagccagagggtttcagactgatgctttccgagacacgtggtaagtggtgactcaggatgacacagctctttggaaatgcctagagcttgtgtccgtgtaccattgggcacaatccttctcaggatggcatcatcttctatttcagaatgagatggatgggccaggagcatggcagcatctactcctggagtaggcattgttggcatttatttttttctttaa

SEQ ID NO: 19986 - DNA, 469 bp, Homo sapiens
gtaggcccaaaatcgaggaagagataggtatcttcagggagaaatgagatatgagctctgacttacctaagcaagaaacatacctatatgaattcagctaaggtggttgttgaatatgcagaatctggcttaatgaactctagtagaagcgggcaaagccctagggataataaataaaaggagatcacactttctttcttagactcatttctccatgaaccccatcacaggttcacaaaaatggttgggagagtctacagaaaatctcccttgtagtgaattgctggaggagaggaaaagaaactgctgtgagaggggtgagaaattctacctggacccttcttgcctacctcccctatgaacaaaagccttaattagtgtgacatgtatgtagaagggagcaaacattatcactctttggatactggtgaaatcccattacatctgagataagggaacagggaaaaaa

SEQ ID NO: 19987 - DNA, 539 bp, Homo sapiens
ttttaaaatcttcttaactaaaaacgcttcacctgaaacgactcatatcattgttctcaatggtatttttggtatgttccaaaggaagtaacttttgggaggaaaatcagtagcctttgtttagttggagatggaagaaatgcattaatcaagagcaaaaggaaaatcagctgcctttggatggagtcataggcattcctggaattttcatggtggaaatattgaatttttgtccatttctggagaacctccacgaagattcacagagactcaagtattaaacgtaatgtgttgaagcacatcagaagaatttgttttctataatatgtttctccctctttttctcactctctccttctccctctctttccctttttctctctccttcccctctctccccgtgtagagcttctaactagtagaaacagaataaaatgtaatctctattaaacataagttataagacaatgttgattctagaaaatgcagggtctcttttggaagaaatatttaaagcataactgttcgataaccaaaaa

SEQ ID NO: 19988 - DNA, 196 bp, Homo sapiens
ctataagatgtgaaaggaaattgttttcttttctcatataatacacatctatttagataaggactagcctctggaatccatacaaaggaatatgctattcctatttcagagcaacctcctctttaaaacatctgttttgaattgaggatttttaacttaaagaacttcaataaacaagaaaaatgagtaagctttt

SEQ ID NO: 19989 - DNA, 366 bp, Homo sapiens
aaagtttaaaggcaaaagcaacaataacgatgactaggaaaacataaaacatattgtgcttacttctgcttggtggaatcatgatatacgtaggagtgggtgattctttttctgtctaagaaatgttctatagggatctacattgtttttaaacttggaattaaccataaataatttttaaaaatgaaaatatgggattataaccaaagccaaatacaagagggtgacacaaaacgtaagaattgcctgagagccaaccaaggtggctcagcctgtaatcccagcattttgggagactaggaggatctcctgagcccaggaattccacgcaagcctgagcgacatagtgagaactcattgctacta

SEQ ID NO: 19990 - DNA, 828 bp, Homo sapiens
tggttataaactatgtacttgacattacacttttgttttccaaaggtaaatttattgacctacaataatttaggataacagccatcagagaactctaattactgtttaagaatacttatttctataaaatatttgatagacctagatttttctttttatagtttatagttgagacacaaatataattttttgttgttgttgtttttgaaacagtctcggcggggtgtggtttctcatccctgtaatcccagcactttgggaggctgaggcaggcggatcagttgaggtcaggaattcaagaccagcctggccaacatagcaaaaccctgtctctactaacaaatacaaaaattactcaggcgttgtagtgcacacctgtgatcccagctacttggaaggctgaggcaggagaatcgcttgaacccaagaggcagaggttacaatgaaccaagattgtgccactgcactctagcctggatgacagagtgagactccatctcaaaaaaaaaaaaacaaaaagaaaacccacgtaagtcaaacacaaaacaaaaaaaaaaatttgtgggccggctggccgagaaattttaaaccacttctgtgggggcggggggccaagagaggtagttaacattggcacaacgtggcccagggagtccgggcagagataggggtgggttctcccaaaaaaaacgccgggagacacgggtgttaacaaatccatgaggtccgcggcgctggtctacacggtcagactgtctacccccccgcggcgggggaagagcagagaaaagaagaaggaaagaacgaaccgaagcaaaggagagaaca

SEQ ID NO: 19991 - DNA, 208 bp, Homo sapiens
ggtgagccgagatcgtgccattgcactccagcctgggcaacaagagcaaaaaactctgccaaaaaaaaagaaaaagaatagtatgggagaagtcatacctattgggtaacactatggttccattgtttatgtcaaggaaaattctggacatattttattgtcagggtctgttttgtgaatactttaattctcttgacttagcctatcc

SEQ ID NO: 19992 - DNA, 817 bp, Homo sapiens
cagagtttcactcttgccacccaggctggagtgcaatagcgtgatctcggctcactgcaacctctgccttctgggttcaagtgattctcctgcctcagcctcccaagtagctgggattacaggcacccaccaccacgcccagctaatttttgtatttttactagacagggtttctccatgttggtcaggctggtctcaaactcccgacctcaggtgagccacccgcctctgcctctcaaagtgcttcgattacaggcgtgagccaccatgcctggccaaattctttagtgaggctttttttttttttttcctctctgtccactggatgccaaggtcaagatatttgctcctcctttctgcgtggtgggttcatgtcttgcttgctgttatactaatgtgccccagctttatgtggggcctcctattagacactttattttggaaatttattttttcttaatgttacatacaataagagtatatcttaacaactgatggtgtttttaaatgaaatgcagtgtggtgttagacagtggcgaaccatctccccttctccatttttcccagggtgctaacactcactggccccaggccatggcttcttacacctaacatatttgcaccaatgtcttagctcaaaattgtgtcctgtagccctctccttccttccaggttcatgtctatttccttggtgcagacttttgtattctttccagctagtgtctggattgctgcctctcaacttctgcacgtctgaaattgtacatcttttgtcctcattcttgaatgacaacgtagcaaaatgtggaattcttgg

SEQ ID NO: 19993 - DNA, 256 bp, Homo sapiens
acatgaataccaccatgagatttgaaagaccatgctacctaggacacaaaacccagaaacaataagaagttgaaagttttgactacataaaaattgaaaatactacatggtgaaaatgccataaactgaattaaaacacaaacagctaattgggaaaatgtttgcatacttaacagataaacagccaacactgccaatatataccaaatttttaggatttggtaagatgatgaagaacgttaagtaaaatcagcaa

SEQ ID NO: 19994 - DNA, 837 bp, Homo sapiens
gagctcaaatgatcatcccacctcagcctcccacagtgctgggattacaggtgtgatataccgtgcccagccaaaatgaacattttaatcctctcttgataaattagagcaacctttctggagaggttatatatttgctgatatatatcaaaagcctgaaaaacatgcatacctttttacctagaaatttgccctccagtaatttatttaaaaaagtgataaggcagattttcaaagatttatagtagtgaaagattggcaacaaccctaaatgttcatcagtggtttgtaagataaacatatttattcaatcatcatttatggagcactttttctgtgccaggccttgttctaggctctaggaacagaataccaaaacctttcattatattgggaatgacacacagtaaactaataaataagaaaatctcaggtatttataagtgctgtgatgaatgtttaattggttactgtgataagaactaaatggggaattactttagattaagtgatcaggaagggctcctctaaggaagcaatgttaagctgagacctaaatgacaggaaggatgctggcatgcaagacatgggaaaagagtattgagcatcttaggcaaaaggaataacctttcgtatagaggaaaccatcagttctgagaagccatgtacttagcggttaagcacacagactgaggagctgtggagctacacagctgccaggtttacagccaggcatctttgtagctccatacgtagttaactgctttgctacttagtgtctgtgtaactttaggcaagctgcttaacatctctctgcctgcatttgcttaattctta

SEQ ID NO: 19995 - DNA, 1008 bp, Homo sapiens
agcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccggacatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaa

SEQ ID NO: 19996 - DNA, 279 bp, Homo sapiens
ttttacagaataacttaataaacaatgtcatacactacatcctttttggaaaggattttacctcttgccctcatcctgtaaacaaggatgggcctctatttaaagaagaggaaaaggaagaggggggaaggatattattcacctggcctagcattttttgagcagatgttttcctcctttcattgttcacagaaaattggtttgaggtcatataaagcaaatgttcaaaaaaactgtgatccataaatcaattcatactattcttttgcttggatagag

SEQ ID NO: 19997 - DNA, 446 bp, Homo sapiens
gcttcctcctgctgggactctctgggaaacaatgtagagcacacacctcacagcgtcccacacaatgggcaaggttgctgaggaatgtctacagcaactcctgagtggtatgaggggtcactgactagtccagggctgctcccagtgggtgccacctctgatgggcacagggtggcagagctggtgctgtgaccatgctgagctctcagatgctgcacccagaagcaaggttcaagtgtaagggctaaggaaatgtgggcaaggcatggcaggtctgacacacaaaggatggtttagaaactgacattattaagccaggaatagagatcactcatgggtgaagaggtctgacctagagtcagaaaattgaaccttgagttttgcttgctgacctcatgagcccgacaagttgctccacctctctgagcatcagtttcctcatctgt

SEQ ID NO: 19998 - DNA, 479 bp, Homo sapiens
ggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtc

SEQ ID NO: 19999 - DNA, 1140 bp, Homo sapiens
ggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggtgtgtggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacgtgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctatttcaaagaaaagtttcactttgggaggccaaggcgggtggatcacaaggtcaggagatcgagaccatcctggccaacatagtaaaaccccatctctactaaaaatataaaaaattagccgggcgtggcggtgggcgcctgtagtcccagctactcgggaggctgaggcagaagaatggcgtgaacccgggaggcagagcttgcagtgagctgagattgcgccactgcactccagcctggacagaaatgcattcataatgcattttaattgcattagcagtgatttaatattatagatgctaacactgtgggtgaag

SEQ ID NO: 20000 - DNA, 1770 bp, Homo sapiens
agtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgtctgaggagcaaaatgtggttttaatgttgtggaaagatcacttgcaagtatataagactgtataaagaagaggactgtgtgcaagtggggtgaaaaaaaaggatacgcgaatgtgcatatgactgaatagggaggaaggtcagggctagaaaggaggctacataaaaaggggcaatggagagtgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaaatatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttctgcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccc

SEQ ID NO: 20001 - DNA, 1266 bp, Homo sapiens
acggcaaggatgtgaggcaggcgagccggacgccgctcgcagcaccggagagggcgcactgcaaaggcgggcagcagaccgtggagagcccgggagcggagctggacaccgcctcggagggaagaaatgaggtagcggcggttcccggacccggccatgcccgtcccctgttctcggagcccagcgccgtctcggccaggccagcccggacactgagcgggccgagcgcgagtccccggcgtccggcggagcgaagatgcagtgagtccccgcgggactgctgcgcggggcccgccgcggccagccggacccagcatccgaccgcactttgggcgagctgctgacttgagaccagcccaaacggggggctttccatctccagcacccctcggaggtggggagcaccggcccctaggcacactcgctgtagagtttccgcgggttttggccccagtcctgagggttgtgtgtgttaggggacccacctcacgttcgccgaggagttcctgcatattcttgcaccatcccgggtgctgttgctggggctctctttatttgcacgcgcgcttctagcttttttcctgacattttccactctacgctcgttctttctcccttgcattttgttgcttgcctgagactctttgctctcgcccttgcccaggctggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaacagg

SEQ ID NO: 20002 - DNA, 3165 bp, Homo sapiens
acggcaaggatgtgaggcaggcgagccggacgccgctcgcagcaccggagagggcgcactgcaaaggcgggcagcagaccgtggagagcccgggagcggagctggacaccgcctcggagggaagaaatgaggtagcggcggttcccggacccggccatgcccgtcccctgttctcggagcccagcgccgtctcggccaggccagcccggacactgagcgggccgagcgcgagtccccggcgtccggcggagcgaagatgcagtgagtccccgcgggactgctgcgcggggcccgccgcggccagccggacccagcatccgaccgcactttgggcgagctgctgacttgagaccagcccaaacggggggctttccatctccagcacccctcggaggtggggagcaccggcccctaggcacactcgctgtagagtttccgcgggttttggccccagtcctgagggttgtgtgtgttaggggacccacctcacgttcgccgaggagttcctgcatattcttgcaccatcccgggtgctgttgctggggctctctttatttgcacgcgcgcttctagcttttttcctgacattttccactctacgctcgttctttctcccttgcattttgttgcttgcctgagactctttgctctcgcccttgcccaggctggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccctaccacagggccgctcccagtagttttattcttcgatcttgcccgggccgagcctggcaggggccggtggctcagcgggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcgggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaacagg

SEQ ID NO: 20003 - DNA, 565 bp, Homo sapiens
ggcatggtaaaaatatatagaaaccaaaagcacaattacatatatgcatttcaaaacacactcattagaatagtccacaggttgtctgtcctcacaagcgtctcagtgttcattaacatctgcccatggactacagcttatctctgaaacagtcagaagtctaaagggaatcggcaataataggactgctttagcattttttaaatataaagcacaatgaagtcaattgttgaacggtgtctatccttacttctctgggtgtgtgactatattttacctggatgttggctccataatccacagatattttatttttctctccattgctgtattcccagcaaagaaaaaatagtagttactaaaaaaaatttattgaatgaatgaatgaatgaatgattcgactgtacctggtgggcatgtgtgtgttcttttatttggtaaaataagaatttttgggaggctgagacaggaaaattgcttgaaactgggaggcagaggttgccgtgagctgagatcatgccaccgcgctccagcctgggcaacagagtgagactttatctcaaaa

SEQ ID NO: 20004 - DNA, 390 bp, Homo sapiens
aacaagtaagaagtttatgtatgaaagtaatcaatgtaaaatataagaaaggaataaatggtacccattttgaatttttaattctaataggagagtagattgtagattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccctgttagccccaatagccatgcatgaaatctttaaataaaagttaaaaaagttctttagaggcatatttctgtaa

SEQ ID NO: 20005 - DNA, 276 bp, Homo sapiens
aacaggaaatgggctcaagattgttacattatgccaaatgaattgggagtcatacatttagtttagtacacgaagcagtaagtgaaaagagccatgcataacaattctgaagtatggtgctgggattacaggtgtgagccacggcgcccggcctctttccttagcttctaaaaccacgagtgttttcaggagcccttcagttgggagcagctgcatctaggacctctaacttcttcagtgttctcgggtggctttgctggtgtcacacctgccact

SEQ ID NO: 20006 - DNA, 627 bp, Homo sapiens
gattttcacacagacactttaggaaagaaactaagtttggggggacttgacctaatcccacatcacagccccagtaatacagccctggaatttatcacagaaagcctagaatcccatgcatatcccatgcatatgcatccctagtcctatgggttcaaggcttggagctctccctggatttagctgggaaaagttggcagacagttcttctctgtcttctagaaatatggactagaatcgtgagtgtgagattgcaagtaacttttaaaatcatctagtttaacttcaccccatttcatagaccaagaaactgagaccagagagagaaatggactttcaagttcaccctgctagttactgatggatcacaagtcaaatctcctgattctagcactgtttctcttacaccacaccacctttgaaagtgtgtcaatcaaatcttactttagttgcagaggatgactttagtttctgaagataaaattgtgagtcaatcaagatgagtcccaagacaatagcctgtttagcccttataagttcagggatgaaaggttagaaagaaacaggatggaaggaggactggagaaaaaaacaaaagaggaaggaaggaggaggaagcaaacagga

SEQ ID NO: 20007 - DNA, 711 bp, Homo sapiens
aggaaccctcagtatcacagaccttgggtcccattctcaatatcaggtgaaactgccagagtacagagtctgatcatatttcctgtggcctaaactcaggtgcctctgagagctgtgggacctgtttccaacttgacatggagagagactgtatgtcttcgacctcagattccccaacctattaggaaacatttgacaattatttataaatagggtgactgtatgtccttttctgtccaagacagtccccatttacgactcttgttctggcactattaatagtgcccgctctgagcctcagattgccccagtttggaccaggaatcacatcatgtcctatttataaactaatttatagcagttttgaacctgtaggagacaacatctaaggtcccagcagtctctgaattgctccaggaagaatcatttaaatcttgggccagggttgaaattacaacataccatcaccagtcatgctgtgtagtggtcccttgttttcctccagctagtttctagaggtcttgtctggaagtgatcctactgtatcatctctccatgactgagtttaggaaacttggttatcaaaccaacctgagttggcacctggctctaccacctatcactgttaccttagctcaatgatgtcacctccctgagctacttttctcatcaattaagtgtggactgtgaacattaaataagctgaagtat

SEQ ID NO: 20008 - DNA, 221 bp, Homo sapiens
atgggtctttcagtgaaactgatgaaaagtatctgaaatctggtttctatctagagtttgaataacacagtgaagttaaaactaacactgaactcatttaatgtaggcagctgctttttttttggcatttgttgatactgtattttatgaaacattaatccagaaactgtgcttgatgaaagtcttttgtagacacatcttatttatttctttctagcact

SEQ ID NO: 20009 - DNA, 355 bp, Homo sapiens
agtgtacaatgtggaatacacaatgtacaatatggaatacacaaggtaatcacaagggtccttgtaagagagaggcagggctaggagcagtggctcacgcctataatcccagccctttaggaggccgaggcgggtggatcacgaggtcaggagaccatactagctaacatggtgaaaccccatctctactaaaaagtacaaaaaattagctgggaatggtggcgggcgcctgtagtcccagctactcgggaggctgaggcaggagaatggcatgaacctgggaggcagagcttgcagtgagccgagaccgtgccactgcactccagcctgggcaacagagcgagagtccgtctca

SEQ ID NO: 20010 - DNA, 318 bp, Homo sapiens
gttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaacttt

SEQ ID NO: 20011 - DNA, 341 bp, Homo sapiens
aattttttttttttttgtagagatgaggtctccctgtattgcctagactagtcttgaactcctgggctccagcgatcctcccgcctcagcttcccacagtgctgggattataggcatgagcctccgcaccaggccgattttcttaagtgtagaaggagaatactgcttccctcctaagggctgtgctgggataaattaaacgatgtatgtgaagcactgacagcgtagtcctctcactcctaccttccctctgctgaataaaggcttcctggggagtcaggaaaaccagcccagagaaccctgaagtggaaggcattacagagtcctggcccctactaacc

SEQ ID NO: 20012 - DNA, 518 bp, Homo sapiens
gactttattaccatccctaaacacacaaaaaaatttcttttagatttactctcactttgcacgaatagcaaacatgcttagaactgcttagattgcacaatgttctcagattaggaagggaaaattggtttgaataaaatacagatgtctattccgctaacaactaaatctttgtgaatgttctgagtcctgtaccatcaaagaaatagatcgtccatgggggtttctatttctggtagattgtacttacacactgaatgaaaaagctttctcctaatattcccagtccaaataaaaacaacccaaggggcacctcttatttaggtcaataaaagtttgcaaatgtggaatactttagccatctacatcacactggtagagactttctgtgatcagctattttttaataccatatttaatcaaatctaagataccatcattgtgaaactcgacattttatatatcactaagaaagcaaaaatgcagcctgggtgaccagagtgaaactccatctcaaa

SEQ ID NO: 20013 - DNA, 968 bp, Homo sapiens
gggggttagaaatacataagttttacattttacatacacatgcatgaagtagtatacatagcatttatatattcacagtataatatagtatttgtatatagtatttttatacctacacatagaaatatgcatagttaattaacatctataaattttctaccataaaaatgtattgcttttataattaaagaaaaatacatattttcaagtcttggaaatcagtaatattcataaatatttttaaagattatgtagttcatctaatcctaattattctaagttttagccacagatgaagttaataatctaaaaaacaacatacttgaatcacatgatgctttaagaaaatggtatcactgagttttgttcacagttatgtcttgggtaaggaaatcctgacaaacagccttatgcaggttattactatattaactgtacaatactgttaaagacattacccactacaacacttaatagctctgatacggaactccacataagaaatttcttcagaggtaactatttagaaaatgtcttgtttcccccaaatatttagcctgttttcttaaagatataggcatttttatatttaaaagatacaaaggtatgatgtcttccttctctttggcttcctggaagcttaaagctaaaatcccagctcaactaggtaggctcctgtggcctgcacagttgtgtcctatcttcctccacacttccacacctcctcaagattgctacttggattgctatttctccctggtttgcaatttgagtatcttatttacatatttttaccaatttgttggtacatgtttttgttgtaagctgccagatagtatttgtgggataagtagaataaaaagaaaatattgtaatcccagcactttgggaggttgaggttagaggactgcttgagctaaggaagtcaagaccaggaaaacataatgagactccgtctccacaaaaaa

SEQ ID NO: 20014 - DNA, 299 bp, Homo sapiens
gatctctactatttgtagagaaatctaatcaaactaataaatgatctgatatccaacttctaatttttgctaccaattgctatattctccaagaaaagtacaaatgttgccttattaattcatgttctggttctgcttcttctcaatctttccctgacacactttgaaatgcaatgtttcatcagctctctgatttcctttcacagcccattttactctgtcacttgtatcccttgtttattcaattcctcctctccagctaagatgtctcagtcacttctctcttcaatatagcttgt

SEQ ID NO: 20015 - DNA, 552 bp, Homo sapiens
cgccgtgccaagcgacacaaagcctgactttacaacctcagagaaagtggaagtaagaaggcttaggtgggcaggcaggacgagagaaagactgagaggagggaaagccgcgtaggtgggagtacagcggcgcgagggtcgagggggaaccctcgtcggtgcagatgaggagggtgggctttcagaactagtcccccctcgcaccccgccccgcccctcccgcgctggggtcttcacggtgccctgcctcagagcccggctccaccacgcccggaagagggagtctggccgtcggctggctcagggcgggccggttggctgtacccaggctccctggcccgagtgcgggaccagagcgcggggcggcgcggcagccgcggaccgaggaggggctgcgagcgaaacggcgcggcgcggcacggcggacgagttagggccggggcgagggaggctgtggctcccgacagagacaggggagtagtgtcgggctgaggcgaggtgaggcgcggggtgcctcgggagggttccccgtgccccgaggggggcggccgc

SEQ ID NO: 20016 - DNA, 450 bp, Homo sapiens
tgccaatgggttatccaggcaagaagcagatcagaatataggaaatatcactcttttgacatgaatgtagttgaaatccatttttaagttagttaaggactaacttaaaaatacctacaaaatccagggagactgacttcagtatttgtcatggatcttcagaatactgaatcccaaatttcaatactcgcttctcaaacagggagaactgttctaaggtgacccaggaatgccagccatacaaatatgctcaagacatggaaaaaaacattaaaatggatttgctgcaactgatattctgtgttctgcaatgctaggtgtgcccttgtagtccaagaactaacactgcagactgcaactagaatgtggtccctggtcatgtcacttccaagaaatatcaggtttaagaactaagcagtatgtgtaagctgaaaagggattaagagtgag

SEQ ID NO: 20017 - DNA, 1480 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20018 - DNA, 1657 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20019 - DNA, 1561 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20020 - DNA, 1452 bp, Homo sapiens
  misc_feature (86)..(86): n is a, c, g, or t
caggagtcagactgtaggacgacctcgggtcccacgtgtccccggtactcgccggccggagcccccggcttcccggggccgggggnaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgagacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20021 - DNA, 1867 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgttgtgtgtgcgcgtgtggagttggcgggaagataggaacaaacacaaagccctttcatccttacctcagaggctgggacttttgcccagagttctcctggtacgtcctttctgcttctgcctcaatagttttcatttcacacagaataaattgtctcccaggaacaccaagaaacagagccacaatcttaaattcctatggtttgcccct

SEQ ID NO: 20022 - DNA, 735 bp, Homo sapiens
tgctctgtatacagtgctaactcattcttgttgaatgttgtgtatggataggaccaggtctggggccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20023 - DNA, 1584 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20024 - DNA, 1664 bp, Homo sapiens
  misc_feature (1419)..(1419): n is a, c, g, or t
  misc_feature (1424)..(1424): n is a, c, g, or t
  misc_feature (1435)..(1435): n is a, c, g, or t
  misc_feature (1450)..(1451): n is a, c, g, or t
  misc_feature (1453)..(1453): n is a, c, g, or t
  misc_feature (1462)..(1462): n is a, c, g, or t
  misc_feature (1465)..(1465): n is a, c, g, or t
  misc_feature (1479)..(1479): n is a, c, g, or t
  misc_feature (1523)..(1523): n is a, c, g, or t
  misc_feature (1550)..(1550): n is a, c, g, or t
  misc_feature (1558)..(1558): n is a, c, g, or t
  misc_feature (1560)..(1560): n is a, c, g, or t
  misc_feature (1572)..(1572): n is a, c, g, or t
  misc_feature (1651)..(1651): n is a, c, g, or t
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggtttttttttttttnttttnttttttgtttnatttcttttcatctnngngcttttttnttncccttttttcattnctttttgttggttgtgatttccccgggagactttacttttttgngtttaagcttttttagggttttgcttnacttttgntncttttttttttncttttctttcctttttttttttggttttttttcttttttgagattctttaatgtttttgcctttgtttttatccattcnttttttttttttt

SEQ ID NO: 20025 - DNA, 1501 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattgatgtaaccctattgtaagtcaaggaccatctgtcttcacttcttgaccaccccacctctaacaccgtaggctgggaagattgtgaatcagaggccagactctaggctttcatggagaaaattttcaaaaaaaaaaaaaagaggccagactcactcttaggcctacccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20026 - DNA, 817 bp, Homo sapiens
gtcagatgattttgtccaactataataggctaatcttaagtgttctgatcacatgtaaggtaggctaggtgtattaaatgcattttcagcttgttttcaacttaacaatgggtttatcaggatgtaaccctattgtaagtcaaggaccatctgtcttcacttcttgaccaccccacctctaacaccgtaggctgggaagattgtgaatcagaggccagactctaggctttcatggagaaaattttcaaaaaaaaaaaaaagaggccagactcactcttaggcctacccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20027 - DNA, 310 bp, Homo sapiens
atcatgaatcgtagcacagtgctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaaggatagggagagtgttgggtgccctccccag

SEQ ID NO: 20028 - DNA, 406 bp, Homo sapiens
tcatgaatcgtagcacagtgctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaaggatagggagagtgttgggtgccctccccagtgctcttgctggggaccctaggtattgctaggggtctccttggctgggggacccgggggttttcatgatagggtcagagaggctgaaggcagctcat

SEQ ID NO: 20029 - DNA, 1480 bp, Homo sapiens
  misc_feature (86)..(86): n is a, c, g, or t
caggagtcagactgtaggacgacctcgggtcccacgtgtccccggtactcgccggccggagcccccggcttcccggggccgggggnaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20030 - DNA, 959 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtccca

SEQ ID NO: 20031 - DNA, 1745 bp, Homo sapiens
tctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctgggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 20032 - DNA, 652 bp, Homo sapiens
agaccctacaacccacaagttactgcaaagctgggcttctaccagaagtgagtgatttgaaattgaaaacagatttcggatctcacctgagtagctcgagtgtaagggagggactgggagagccacagagaacatttgtcaatccagaaccaaccattcatggtgttgcttgactggagggcagggaaggaaaggactagaagcaaggcgaaacaggatctttctgtagatacacacatataagtcttggatttgcattttagggtgaattgtaattagcttgagatgaccaggggcccaccaatcaagcaactctgggaaaaacacttgtctacatcttaagtttctttgtctataaaatgtcaagatttgaactaacactacatgattctctcgggaactcaccagttctaaaatttccactccttcttttcacagggcagtgtaactttaactccctgtttcaactttgggtgtaaaatacaggctcacaagcacttttgctttgcagcggaagctaggaagaccctgctgtggaattttgcagaggggctgagcagtggtgggaaggaccagcggcccatgtaccatgttgggcccctgcattccaaggtgtctgcctagaaataaatgatagtttatttaacatact

SEQ ID NO: 20033 - DNA, 751 bp, Homo sapiens
tctctactaaaaatacaaaaaaaattagccgggtgtggtggcacatgcctgtagtcccagctactcgggaggctgaggcaggagaatcgcttgaacccgggaggcggaggttgcagtgagccaagatcatgccactgcactccattctggtgacagagcgagattccatctcaaaataaataaataaataaataaaaaataaatgtcatctagcttgttttgatggttcaagtaaagataagtcttaacatttgtgatgctaatctaaagctttgttaaactggaaatgagactttgctaagcagcatatgtgtaacaggtgatctgatccatgtagtcattgtgcatgagtgaattaatggtttaaaatttgacttgtactgcttgataaaagaatgtttctattaggttcttggcagggtctcagaatgtgattttattcttagtttgtgtgctctcatctaatattgcttctttgggtagggacagaagtaagtttttgccctcagtcttttgttttcagtaattaagaacaaataatacatattgataatctgttaatattgcataatatatttgaaatgaaagtagcctttaggtgttattgtagaacatgtcaatccagttttggctgggtgtggtggcacgtgcctgtagtcccagctactcaggaggctgagacaagaggatgtcttaaggccagaaatttgagaccagcttgggcaatatagcaagacctctgtctcaattt

SEQ ID NO: 20034 - DNA, 189 bp, Homo sapiens
caggagtccaagcaagaggattgcagattgtagcctggaagaggccagtagctgtggtgacaatggacaccaggtggatatgttggagagacacttagaagggtctcactctgtcacccagactggagtacactggtgtgatctcggctcactgcaacctccgcctcccaggctcaagtgattctcctg

SEQ ID NO: 20035 - DNA, 734 bp, Homo sapiens
gtacaataatccccctgtgtatctatcactcactcacaacaatcatcaaattatagctctgctggtttttaccagttattgtgaaacaaatatcaaaatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgta

SEQ ID NO: 20036 - DNA, 1099 bp, Homo sapiens
ttttttttccctctcgctcctcggctgcctctggaatttttttttttcacttgccctctccagctcccactagtgattggagactgagagccaagtacttagcggagggattacacttctcaacgcacttggagcggccccagcgccgccgcctgtgtgcggagtgcggagccgacttggggagcggcggggtgcgggccggaggcagcccgggtacaggggtgcgcttcccaagccccgtccgctgctcagagcatccccaagatttccctcatgggtcctgtcctggttgtttaagaaggtttccagaaaacctcctggtttgaagaacaaagattcgtggaattattgtaccttgagagctggaaagggctcgcagagatgatataatgtcgtggatttcaacttttcggggccatagacacttttcagaaattgataaaacgttgacacaccttgtaaaaaatgaacacattaaaattaagcctgcagtttgaggtaatggagaagcactggagatttgtaagccacggagtcaaatggtggactgggattttcaggagatcatttagagtagagacggagtttgatcatgttggccaggctggtctcaaactactgacctcaagtgatccactcaccttggcctcccaaagtgctggaattacatggagcaagatcttaccaaatcctttagtcatggtctatttcgttgcactcatatggttgttactgcgaaggtgaagaactaatgactgcagcaggaaaaagaattggatgtgtcatgaattatggccctgcttatacttctacttcaaccgtaatcatttgtttaaacaaaaagttctgcatttgaattgtcacaattgtgtgtgtgttataaacatctcatatttcatccaggctcagccaacacttgcctttattaatgctcataatcaagaaataaaatctcatactaaccaaaaattatccttcataagagaatataaacagaagtctggttcataaacttactaattaacacctctattctcatgtatcaactaacatttttgtttcgtcttaaaataaataaaactttatgacatgctaataa

SEQ ID NO: 20037 - DNA, 1001 bp, Homo sapiens
ttttttttccctctcgctcctcggctgcctctggaatttttttttttcacttgccctctccagctcccactagtgattggagactgagagccaagtacttagcggagggattacacttctcaacgcacttggagcggccccagcgccgccgcctgtgtgcggagtgcggagccgacttggggagcggcggggtgcgggccggaggcagcccgggtacaggggtgcgcttcccaagccccgtccgctgctcagagcatccccaagatttccctcatgggtcctgtcctggttgtttaagaaggtttccagaaaacctcctggtttgaagaacaaagattcgtggaattattgtaccttgagagctggaaagggctcgcagagatgatataatgtcgtggatttcaacttttcggggccatagacacttttcagaaattgataaaacgttgacacaccttgtaaaaaatgaacacattaaaattaagcctgcagtttgaggtaatggagaagcactggagatttgtaagccacggagtcaaatggtggactgggattttcaggagatcatttagagagcaagatcttaccaaatcctttagtcatggtctatttcgttgcactcatatggttgttactgcgaaggtgaagaactaatgactgcagcaggaaaaagaattggatgtgtcatgaattatggccctgcttatacttctacttcaaccgtaatcatttgtttaaacaaaaagttctgcatttgaattgtcacaattgtgtgtgtgttataaacatctcatatttcatccaggctcagccaacacttgcctttattaatgctcataatcaagaaataaaatctcatactaaccaaaaattatccttcataagagaatataaacagaagtctggttcataaacttactaattaacacctctattctcatgtatcaactaacatttttgtttcgtcttaaaataaataaaactttatgacatgctaataa

SEQ ID NO: 20038 - DNA, 1141 bp, Homo sapiens
ttttttttccctctcgctcctcggctgcctctggaatttttttttttcacttgccctctccagctcccactagtgattggagactgagagccaagtacttagcggagggattacacttctcaacgcacttggagcggccccagcgccgccgcctgtgtgcggagtgcggagccgacttggggagcggcggggtgcgggccggaggcagcccgggtacaggggtgcgcttcccaagccccgtccgctgctcagagcatccccaagatttccctcatgggtcctgtcctggttgtttaagaaggtttccagaaaacctcctggtttgaagaacaaagattcgtggaattattgtaccttgagagctggaaagggctcgcagagatgatataatgtcgtggatttcaacttttcggggccatagacacttttcagaaattgataaaacgttgacacaccttgtaaaaaatgaacacattaaaattaagcctgcagtttgaggtaatggagaagcactggagatttgtaagccacggagtcaaatggtggactgggattttcaggagatcatttagagtagagacggagtttgatcatgttggccaggctggtctcaaactactgacctcaagtgatccactcaccttggcctcccaaagtgctggaattacatggagcaagatcttaccaaatcctttagtcatggtctatttcgttgcactcatatggttgttactgcgaaggtgaagaactaatgactgcagcaggaaaaagaattggatgtgtcatgaattatggccctgcttatacttctacttcaaccgtaatcatttgtttaaacaaaaagttctgcatttgaattgtcacaattgtgtgtgtgttataaacatctcatatttcatccaggctcagccaacacttgcctttattaatgctcataatcaagaaataaaatctcatactaaccaaaaattatccttcataagagaatataaacagaagtctggttcataaacttactaattaacacctctattctcatgtatcaactaacatttttgtttcgtcttaaaataaataaaactttatgacatgctaataaaaatatggcctcgttggcctcagcggtggagctctgcggccg

SEQ ID NO: 20039 - DNA, 866 bp, Homo sapiens
ttttttttccctctcgctcctcggctgcctctggaatttttttttttcacttgccctctccagctcccactagtgattggagactgagagccaagtacttagcggagggattacacttctcaacgcacttggagcggccccagcgccgccgcctgtgtgcggagtgcggagccgacttggggagcggcggggtgcgggccggaggcagcccgggtacaggggtgcgcttcccaagccccgtccgctgctcagagcatccccaagatttccctcatgggtcctgtcctggttgtttaagaaggtttccagaaaacctcctggtttgaagaacaaagattcgtggaattattgtaccttgagagctggaaagggctcgcagagatgatataatgtcgtggatttcaacttttcggggccatagacacttttcagaaattgataaaacgttgacacaccttgtaaaaaatgaacacattaaaattaagcctgcagtttgaggtaatggagaagcactggagatttgtaagccacggagtcaaatggtggactgggattttcaggagatcatttagagagcaagatcttaccaaatcctttagtcatggtctatttcgttgcactcatatggttgttactgcgaaggtgaagaactaatgactgcagcaggaaaaagaattggatgtgtcatgaattatggccctgcttatacttctacttcaaccgtaatcatttgtttaaacaaaaagttctgcatttgaattgtcacaattgtgtgtgtgttataaacatctcatatttcatccaggctcagccaacacttgcctttattaatgctcataatcaagaaataaaatctcatactaacc

SEQ ID NO: 20040 - DNA, 481 bp, Homo sapiens
cgctatctcttctggcactgtgggctttgccaggaatgctgtctccacctctccctccttagccatccttcaaggccagcttcaatgccaccacctccatggagccttctcggggtcctgcattgcctaagattgccccctgccaccagcacagtcagcaccactcacgttatctgtctcatcatccatgtgccgtgtgtccatttaacagaactatatggaggacctgctctgtgccagacactgctaggctggctaccgcaatgaccaagaagtacagggcccctgccctcaggccttgtgtcttgtcccccacccaccccaaccaggagcagttagcccccagaacttgaggcaggagactctgtctctcctcagtgtctggcccatagttggtgctcaacaatgaatggatggcatgtgctctattggttgaatgaatgagtcagtggccaaataaatagaatgaaatgtgaaaaag

SEQ ID NO: 20041 - DNA, 280 bp, Homo sapiens
gaaacattttctaatgtatttaaaaatctccccagtgaagaatttcagtaggttttgaaactatttatttaaaatgtaaaattgaaacaccttgggattactttgaactggaacaactgattgacatcaggacagacaatttttgatacaattttctaggcaaattgtatcaaaaaattgtgcatggttagtggggcagatttaagatattagtactgtgcttccacctgtcaagccaattatgtgtttctttgtatatctttggggattaaaaaaatta

SEQ ID NO: 20042 - DNA, 507 bp, Homo sapiens
cgcggcgggggaagaaccggggggcggagagggggcgcgctgacgtctcgccggcttaacctgttgctctcgagactgcgtcggagcccgcaggcagggccgcgggaagccggccgggccgccgccgccatgctcggccgtgtgcgcgccgccgccagccacgggcttgcagccggacgcccggactcggagacacgatccgctgaacgcccgcaataagaaagaaaacccaccccacgctgctctccacctcaacgaggtccggaatgggaggcggggtgcggttctcgtccaagttctaccccatttgctttgtggctgcatccgaaacggacgtgccccgggaaggcgtccacgctccaagacaaggttgcctcagtgcagtttctacagcccgagtttaaactagtcctttgcattctacccagccctctgcaatgcggatgtattttaattcttaaattctttatggaacagcaaaaacacaaaaagaagtctcaagcgcgt

SEQ ID NO: 20043 - DNA, 385 bp, Homo sapiens
aaaatcagagctctttatttcagatggagttatctcgttggcttactatttaaaataagaatttgtaccactatacgttggctaactctgatgttaaaggaaacttgctgaaaactgatttttgttttggcaaaatatagaattactacttttcctggtgggcctaagccagattcagtgccaagagggaggtagggagaagtagggttttttttttttttgccagcagatgccatcaatcttgaagtattctggacaagtgaggagagcataaattaagactattgacgtcaaaatccagataaacttgaatccaaatcctagtctcatcattttatcaactatgtgcccttgagcgaattactgaatctctctgagtttctca

SEQ ID NO: 20044 - DNA, 136 bp, Homo sapiens
gagagagagagaatcttccccaccacctctttgacctggatcattgcagggaggggcagcaaaggcaaggggagaagagtaaaatgatggaggagggaaaggtgattgcatttgctccccctccaaaccagcttct

SEQ ID NO: 20045 - DNA, 491 bp, Homo sapiens
aagtttgtcactgacttgtgttcctgaaccatgaagcatgaatatgtgggctgagaaatagtttctcttgataaataaacaagtaacaaattttaaaaagagaggaagatgaagctgggctagttgggggaaggagagctggtaagggatctggtcttgatcctaacagcaatggattaacctatgttcaaatcccttaccatctgtgtggcctcaagaaagttatttagcctctctaaaccttagttttctcatctgcataatgagaacaatgagaggacctactttacaagattaaatgttaatagatgtcaactactaagaacactaatcaatgctataattgttgttttgttgtgctgacactaatcaatgctacaattgttgttttgtcgtgcttcagacctgaggttctaaagaactctatttgtacctcatagcactatgggcaaaataattgctcaataaatgcttaagatcagggtagattt

SEQ ID NO: 20046 - DNA, 278 bp, Homo sapiens
tgaaaattcaccaaaaaaagagaggaagagctgtaagggtgagcagtctagggtaggatgatggtgacccttaggggtgggtcaggaggtgaggccaccaaggtcatggccaagagaatgtgaactctcctcagtgagttaccttaaaagttaatagtcaaaactgggcatggtggcttacgcctgcagtctcagctactcagaagtctgaggcaggaggatcacttgagccccgtagtttgaagtccaggctgggcagcatagtgagaacctggctc

SEQ ID NO: 20047 - DNA, 545 bp, Homo sapiens
aatgtactaggctgggaggcagagctgtggctgggcccagatgcacagcttctgcactggtcctgaaatggcctcccaggggagcagccatccagttactgtggaacaatctctgccacctctgtacccctcccatccggaactcgccatgccacagtgcctgtcacgaggaagctgggcttcctattccctctcagaaaagccagttgtggcaaaccagtccccacagcttcccttcatggtgacactagtcaggacacatagtttctgatacattcagggttcctccctagcaccacacagaaacagacccagtaatcttcagtttttaaagaattaatctgagagaatgcctgtcccaactctatgtgctgataaatatatgctctgtcttgttccaactcatggataaatatagttttgactggtaaactgaaacaggacataagacagagccctgcggaactccactagagactttctcccaatgttaacatccgggtattagagtctttcagaacaggcattctgtcaggagctaatac

SEQ ID NO: 20048 - DNA, 317 bp, Homo sapiens
tatgtttgctactagaactgggttggcatctaacttcctttgtaaaagcactacaaattaactattgtaagctgtgaaatggagtttgtagtaacagacctggcaagtaaacacctagtgtttgtctcttaaaaaatgatgtattacagctccaccaggtggctgccaacagtgtgaatgagacaggctggcatcgaccaggaggaggggaaagctgctcttgattttctttgtgcatatcggagtctacaacataataatttagtgaaggacaaagaagggagcccactgcaggtttttctaggaagtctggcaaa

SEQ ID NO: 20049 - DNA, 425 bp, Homo sapiens
cgaaaccctctctctactaaaaatacaaaaaattagccaggtgtggtggtacacacctgcagtcccaggtacttgggaggctgaggctgaggcacgagaattgcttgaacccaggaggccaaggtttgcagtgagccgagatggcaccactaaactccagcctgggtgacagagcaaaactctctaaaagaagaaggaaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattacctt

SEQ ID NO: 20050 - DNA, 291 bp, Homo sapiens
gtcgatccggtgcgggccacacaggagatccagaccccggctaacctgggccctggctggggctgcactggtgggaccctggtctctgaaggcagcctgggagctaatgggcaactgaagctcccagtcaccaccatcaggcttccacaccaactggcgaccagggcgcaacgaaccctgcgtaccatgggggctcagtgcctctcacaggggcggctagtgaagatggagtatttacaaatgctattaaaacaacctctcaacttcaattggagtccggtaatgtgataa

SEQ ID NO: 20051 - DNA, 498 bp, Homo sapiens
tcactattcaaagctctacctctgagaactaggtataaatgaagttagctcttgagctctgaaaatcaactaacaaacacagcccactcattggagacattcattcaacactatttacttattttttaaaagataaattgtattgtgtatatttgaggtttataacatatgttatgggatttatatataaatagtaaaatgtttagtgaagtaaattaacatgtctgtcatctcacatagttactttcttgtgtgtatgtcaaaggcagctaaaatctgcttatttaacaaaaatacctagtacattacaattttgttagccatagtcgtcatgttatacattagatctctagacttgttcatcctacatatgtgcaactttctatcctttgacctacatctccccattccctgccacctcccatttactcctaatttaggctaatttaattctggttttccagcctataacatatcaaaaaaatttttttgagtcag

SEQ ID NO: 20052 - DNA, 741 bp, Homo sapiens
aagagaacacagaattcaattccttttcagaaaattttgctgcttcaagctgtgcttgggcttcttatccttactgtaattgtgaggggtgaaaatagtcctttgaactttttatgaggaaagtggtggtgttctgtaaaggacatttatttaaatatgattgttattggcttccataatcccccatgtcatctgacctcggattagacccagtctgccagtctgatgagagagccagttgtaagttacctgttgaatttcctgtggatcccctctgttgttctttattagctccataatccagctggatgttactggttacagtttggctaatgatcatgaccaatttttgaagaaaggattccttattggcgggcaaatttttgttgagtggtacagccagaaacattttcacattattctttcctactttaggagctaaacttgcgggctgtttatgtatttgtttttagggtaatcaaattttttctttataacatttgtcacagtgacatttcttatgcacacataaagagtaaccagatattacactgtatgttttggaggaaactgttctggaagacctaggcctaaaactcacttaataatgaagttggggaaatagattacagttcttattaagaaaaaaaatttcatgttttaaagcccccctttatttgccaaaatattccaaaatagtatatctccttgacatattatccagaacccaatatgccttac

SEQ ID NO: 20053 - DNA, 235 bp, Homo sapiens
taggaaaaagagaagctatattcaatcattgaggcatttttcatggtgaagggctggaagtcaagtttgttctaacctcaggatctttgcacttacagatccctctccagatcacctttttccccagaactttgtaaaatttgccccttcacatccatcctgtttcttcttgaaggtcatctcatcagagaggggatcccagaccaccctaaaatcaccaccacacatcactcat

SEQ ID NO: 20054 - DNA, 490 bp, Homo sapiens
cgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccccggaggcctaggcagaaggaagctggcctgagccaatcacacgatgatgatgtccattgctgtgtgatggcttggaatttaatttattaaagtcaaattggagttta

SEQ ID NO: 20055 - DNA, 433 bp, Homo sapiens
acccctatgcaaaatgtacagtttataattccaaatacatacatatatatatacacacacacctgaatagccttaagtcctttccatatataaattatttttattcatttcatcttttcttttttaaattttgtttttgtttttgtttttaatataaatatatatataaatacagagacagggtctccccatatttcccgggctggtctggaactcctgggctcaaggaacccacctgccttggccttccaaagtgctgtgattacagagatgagccgctgtgcctggccttattccatcttttctttaaagttttcctgttcacctgagcacaaagtgacttctctcttctcatgagctgtatgacttttggctttaaagagctctttctgtaacttaacattttttcctggttgtgtggttttaatcctca

SEQ ID NO: 20056 - DNA, 730 bp, Homo sapiens
agacctggcgaaatacctggcggcgttttgtcgtgtaaccgccaactttatcggtagcacgaaggcacaaagatctgggttgaagaagaggcgaaagctaattttaaaaaagcacctccctgcccccgggtattaaactgtaccatttgcctttcacacactgcaacttcaaccgttgattcactgttttgagtattgagctctttatgtgagaaaccaaaggtgggtgtcttccttccaccacctcttttgttcccgtcttgtgcgctgtactgaaatcctgtatttgctttgactttaattccctggttttctagtgccgcgggtgcgcatgagtgcattttaaatcaaacagcttagaatttatacgacaaatgtcaattacaggtcgacagttttctctttcacagtgcccgtgtctcgctagtaattagccaccgttgctttgagaattcgaatcaatgattactgatccagtaattcccttaagtaaacatttctttcggcaataaagacaatttccagttactctcatggttctttatcctggattcctagctgattagccttgtgtttaatgctggcatagaagccatgttgactcataattaaaaatcactgttgtgtaacattttgcccacctgctttttcctcttctctgttcagcccttccctgtgtagaggaagttgtacttctttgaaaggaaaagtaaacatttttattactgtt

SEQ ID NO: 20057 - DNA, 836 bp, Homo sapiens
  misc_feature (34)..(35): n is a, c, g, or t
atatggttccggggggcgcagaatcgcacaattnncaacagctcttcgtgatgtttgcattcaactcacagtgctgaacctttctttgatagtgcagctttgaaacactctttttgtagaaactgcaagtggatatttggtcctctctgaggatttcgttggaaacgggataaaccgcacagaactaaaacagaagcattctcagaaccctcttcgtgatgtttgcattcaactcacagtgctgaacctttctttgatagtgcagctttgaaacactcttcttgtagaaactgcattttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagag

SEQ ID NO: 20058 - DNA, 332 bp, Homo sapiens
caaggttttgctttatggttaatttagctggtgatgagagcaagctgaaacttgtgagaagagacataaactgcaacaaaccgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaagaaaatgttccaatatttccattggagatgaggttcatttgacattagcataacttcaaataagtgtccaaaaa

SEQ ID NO: 20059 - DNA, 270 bp, Homo sapiens
gagctgtccttgctcaagatgggtgaaggggtgctttaccagatagcatttgtttttccattgacctacaactcctgcttttaaggctcctgcgaaaatctctcaggctgattctctctgttgtttcagtgtgtgattcttgagaaaagaatggtatactttacctagttagccattttcagggctcttgatgcttgcattaaaaaaaaaatctttttctttatcttctactctaactcttcctcccctcaccgcccaccccccgaccaa

SEQ ID NO: 20060 - DNA, 432 bp, Homo sapiens
tctaaggctgctcaggtgaccagggaaaggcactgctcacacagggcttgaacaaagaatgcatccagcaaagctctgtgtgggggcctcctgtggccccagctccaatgcactgagcttcccacggcgccaagccgcctccacagagccaggggaactatgcacatgacacactgtacagggacagaggctctagggagtgccaggaacagtttcagtcgtagccctggaccctttgggatgttatgatggcccctcctgctgtgacagctgagggagattcacagcatattaaggcccatggctgtgtgctggcagcagggagatggctgagcatcatctcaggagccatttctctcgcctccctgcccctaacgaccaccttttcttttctttttttttggggggactagaatcttgctgtgttgccca

SEQ ID NO: 20061 - DNA, 548 bp, Homo sapiens
tagataggtcttctggccatggttgttgagatgtttgttattgaaagatcaaaggatagctgttgcttaatggtaaaacaaatttccaacaggctcagttttagttcccttattcctaaagtatagataacacaaaagcaagaattttgtttttagaaaattagctactccgtaggctgaggcagaagagccgcttgaacctgggaggcagagactgcagtgatgccccatatcatatatggaatgcatccccatttacacctaaaatttgaaacagaatctgagaaacaaaatatttctaatctccttcctgatcctcttcactgataccaggtttgcagaaaatataaggccagctcttatcttttgagagaagactcttatttctttgtctaagattgtctatacccctttttatctgcctcttttaaaaatccttgtccagccactatatttttaatttaatcaacactcagtttttgcttttcctgtttttttttttctgttttttgtttgtttgtttgtttgtttgtttgagactctatctc

SEQ ID NO: 20062 - DNA, 372 bp, Homo sapiens
atatgaaattccagatcatgggagggagagtttgaagaaggaagaaccaccaatagaaagcggtccccaaagaggtatcggggatggcacccagacaggagcacatgtaccactgcccagaatgtgcatttcactagacaagtgaccacaaaagttttcactgtgacttgaaaatgcccactcctcccagaagttcaaggaactggacccccggacatgagcccaaggttcgccggcttcaaagatcctggccacacaccagtgagcctggcagaggcaggcttctggtcctctttcccagtgatttcctgctggcctgacaccaaactccactttccctgaatgactctaataaaagtttatcaaaactcc

SEQ ID NO: 20063 - DNA, 1236 bp, Homo sapiens
aagatgaatatttctagtgatttataagttacttgaggaaatcatgctgtttattcttttcctttttaggtattctttgtgaatttgctatttgtgtgtgaatatatctgttgcgataatgaataaccatatgaaatggataattgtatgaaaattcatttgtaattcaatagattgccagggattttaggttggttatgaaggtttgttttttttttttttttcttttggagagtggggagattggcatacagtttcaaattgtttatgtggaagttggaagtgtgactaagctcgaagaaaggaagagagggacaaagaaagggaggaggtacccctaagtgggaacctaccaggacattcaaagcaagagcagtaagttctgaatgttctgggacaacctgggtgatatgcatggatatgggctgtggaggctgagcattttaatgataacttagggaaacgaggcatggccatggtgtaaaactctcaaatcccaagccctaatccaaccttaaaatccgagtcttctaaagggctgttttaaccatgaaaggaccataagaaaggcaattcacagaaaatgaagccatgtggccaagaaatataagaaaaacagtaaaaagcccttaatctcaatagcaatagagtggatgcaaatgaatataatgagttgccatgtcgttcttactggattggaacaacgaaattagaatgtctaaataacatgtatcatccaggatgttggggaaatgggagctcttgtaccccctgaaggcagggcatttaaattggtgcaaccgcttggatgctgctatgtagtatctggtgcactgagggatgaacatggcctggacaccaggaacccgcacttctaaggtcaataccctaattatatttcttccgtggttcacaagaaggtatgtaaggaggctcaatggactgaggcgatgtgtacactgaggggcacaggaaatccctctaagagtctgtcaagcagggactgcatacgtgtcatcggtcatctaacggggcgtcaagtcagggacgtctcaacattcctaaggatggactgaaacgcatggaaacaagcgacagtgaaacagggcagctccccaagaacgacaaacacgacataccagcaggcaacacgcggcaacaaataagagacagcgagaacgaaaaaagagacagcgacagggcgagcacaaagaaacagagaagacagacggagaa

SEQ ID NO: 20064 - DNA, 434 bp, Homo sapiens
catcctttggggaggagatttgagatttctctaggcattctgatcaaacctagataggatacccaaagatattgatggtaggcatttcccaaataaatagctcaatccgattcctctacagtggagtccccacttcccaagccctgagtcccactgacatactcaaagctcccagacagcttttttagttccattctaaaggcttaccagacaaaggaagaaaacatctgatatgaaagggagcaaaaccaactaaaaagcaacttagaggaaacagtcatgcaagaggaattaatttgaaatagttctttacactgggcgtggtggctcacacctgtaatcccagctctcagggaggtaagaggcgggaggatagcttgagcccaggagtttgagacctgcctggccaatatagcgagaccccattctccaca

SEQ ID NO: 20065 - DNA, 306 bp, Homo sapiens
tttttgtaggaattggtggtgtcttggaatatctgcttcaggacgataatgaaactaatgatttagggcagtagaagaagccgtgggaggaactttcacatttggcgaggcaagtacaattttgttagggctttttgaaactgcatttgaaaacttgcttagcggttttgtgattcatggtatatatcaaattttattgaaaagctgtcagtgaacaggatgagaagttctcttttaaatacagtcagaggcattataaaaactagcaattctaaacttactgcaaaataaaaattacccgaaaga

SEQ ID NO: 20066 - DNA, 369 bp, Homo sapiens
aaaaggaaaaaaagacaatttagttgagcagggttgacaaatctctcaaagcaggtcatggtgcaaattcttgtgtgcctgacacagaaaaataagtagcttactattgaccaatggtaatttcattcttaaattaagacataggcaatgaaacgtagacaataagcatattttctccctttgagttctacatgcatcaaatgaatctttgagggacattccaccaggccaaagtctagactaaacaggtgtaaaaatgagaactattttaatttttaaaaattaagaataggctgcatgaagttacagcagagaaaaggcaaggcaaagaattatatcctaaagtatgaatcacatgtggcttgagtt

SEQ ID NO: 20067 - DNA, 182 bp, Homo sapiens
gtgacaaaatggggcaatagttctgtaaggctgagagaagctgggggtgtacccagtggctaggctactcagaggggactgtcatgctgtcagtagtgtagtgggagccaagcaggctttactcaccggcctgttaacagctgtgcgagtcatgcctttcgcttgtgttagctcaccttgtg

SEQ ID NO: 20068 - DNA, 406 bp, Homo sapiens
aatttcccagactgaaaattcagtgtctctgaatcacagagacttgagatcacacatctctgcaagaaaatcatccctgaagctgggagcgacagaaagatgctgtctctgtctccctcactgtgagtgtaaggtccagtcttgtcctgattctgccctgggcttgcatgctgtcctgttcctgttatagaaagtagggctgatgacaccgccttgcagggctgagaggtcacatgtgagtgtgtgtacttgagatggcagcacggcccttgatttttccattgattcaacaccacgtggtggctgtttcttttttcttttctttttttttttttttttataagacagagtcttgctctgttgctcaggctggagtacagtggcatgatctccgctcattgcaacc

SEQ ID NO: 20069 - DNA, 506 bp, Homo sapiens
agacaatataaatataaaatcaaagaagaaatgacgaacaggaggatgtaaagcagcactgtgatcaccacgccaagaatgcctggctgcacggttcttacaaacatccagtagagcttcgcggcatccgccacaggagtctcctcattatctgtaagccgctgacaaaagcaaattcagatttgaaaaactcagaatgggaacactgatcaccaagttaggtgaatgtaaagatacaaagactatgtgaccctataatttgttttagaattaaatcttctaggtactgaagattgccagcttttcaggtgcacaaaggaaaagaaaaaaggctgggttttgcatgctactttaccaggtttttctcatcttccctctaagcctttacatgcacacactcgacatgcaattcataaagtaaaagccatgttttatttatgtactattaacttctgaatttaatgagcacaagacatgaagaaattaaatatgatggtgaaaagagt

SEQ ID NO: 20070 - DNA, 412 bp, Homo sapiens
gtctacacactgctcagccacatgactggaacagtgttttcacaggaatggcagcacaagcgatctgaacagcgctctgatgaaatcagcactgacctgtgcctgacgtcctatactcctcagcatggctttatgggttcttgcaatttttcctgtgggtgtgaaaatgcctggaagtccactcagtgagctttgcagtggttgctccgtaggattcctgttgaactgcctggccttcagccatggggagattttgctgaggggtaggcttaatggtggccctgaatattcctgctgcccagcagctgggaagtagttagctgagcaagattcatcttcaatgacgaaggggatttccacaaggtaaattgttctaacctcagagatgagtgtgattggatgctcccaactt

SEQ ID NO: 20071 - DNA, 704 bp, Homo sapiens
ggtcgaattgcaggagtcggggctgcatcagagtcctaggtgggcaacatgggaagagaactgctggaggggcacaggagggggtgagactgaaatagaaaccaagacttgctgatggtactcctgaggggatcgacacagggaaatgtaacagggagtgggcgaagatagagaaggtttctcacattggctttggaagtcaagcactcagttcaggctgagagaatattctctcttagttcctgctctctggagtggagtagttcagactcaacagaaaaagctttgctgggccaggcgcagtggctcacacctctaattagaacactttgggaggccaaggcgggcagatcacctgaggtcaggagtttgagaccagcctggccaacatggcgaaaccccatctctactagaaatacaaaaaattagccacgtatggtggcgcatgcctgtaatctcagctacttgggaggctgaggcagaagaatcgcttgaacccgggaggcagaggttgcagtgagctgagatcacgccactgcaccccagcctgtgcgacaagagcgaaactccatctcaaaaaaaggacaaaagaaaaaaaagaaaagaaaaagctttgctgggtctgttggtctgttcaagtagggacaggaagaacttgtaggtgacagagcacattgcccagcattgtcatgggtcttgggata

SEQ ID NO: 20072 - DNA, 204 bp, Homo sapiens
gttagtctctatctcataccccacatcagctagccagccctgattttggattttgtagatttgaaaagaatctttataatgccctgttgggggaggtgtgcccttatcttagtctgctcggtccgctataacaaaataccatagactgggtagctaaaacagcagacatttatttctcaccattctggagctgaaagtcagaga

SEQ ID NO: 20073 - DNA, 329 bp, Homo sapiens
cagtagtcagctctgttttaaaacaattgcttgggtcctgctggctcaacttgcagttgtcctagtcctgagtcttgtcttagccaaagactgttgttggaaagcccacacaaaggccttgtgtataggatgccctactattaaaggagcatgttctagtctcagtggattaaatttgctttggtgtgcattcccttaccaaatttctcactactttgtttggctggttatttcagtgaaaaatcattttaacgtgaaggcagatttcttctaattattacatagtcctagtggtgacggttattggagtaaaataatttttttttttt

SEQ ID NO: 20074 - DNA, 479 bp, Homo sapiens
aaccaaaatagagctggagtcatcatactaatatcaaagaaatagactttaaaacaaaaagtcttattagaaacaagatgtataggatatcaggaaaatggaacaattaaaatatatatgcaactaacaacagagtcccaaaacaagtgaactaaaaacagaaagaactgaagggagaaataggcaattctgtaataatagttggagatctcaatatcatactcttaataattgataggccaactagaaagaaaatcatcagttatatggagaatttgaacaacactatcaattattttgacctaactagtatcttagagcactccatccaacagcagcagaatgcatattcttttcaagcacacataaaacaattatttagaatagatatgtgatagagcataaaacagttctcaataaattgaaaataattgaagttatgacaagtatgttgtccaacaaaaccagtatcgcattaa

SEQ ID NO: 20075 - DNA, 458 bp, Homo sapiens
tatgaaaggccgttccagtgtctggcagtaatgaaatctgaccctcagaacagagcagcagtcccgaatcagctgatgggctgaggtggcaagtcattgtgcctttatcaaacaagggagcccttcctgggaatttcctgaaatacttgggaagtagatcctggtaaaaattggactacctgaagttaagtttggactattgtcaaaatcctaaagccaagtgtgacttctaggctggaaaagctaggacttctgggttacatagcacctgagggcttcaggaagcacgaaagataggatttgtgtgcaggttctaagttctaaggtcagagcctgaatcatggagtaaaatgtgaatcaaagttttcaacaaggatatgttaagtagggttttacattaaggccactcaagaataattctgtgtctaaattcatctatacatattcttgtcaataat

SEQ ID NO: 20076 - DNA, 733 bp, Homo sapiens
tcacggcgaactaccagggaccattatttgggtatatcaaggcaagttaggatttagtttctctgtggttttattaataacttgtgacttgggagctctgatttgcctattgtactaatttaggtgggattgattttaggtaacattggggtaccagaaaaagatcttctttgaaagatcttcttgtctccaactccttaaataatgctggatttggggactaatgggtgataaaatttaaaagatagtgagaacccgattatagaagtcctctcaaaacatccatatgtcatttgcctttaaacctataaattacaatatacactaaaaccacactctcatatctctactcattttggtgtgaggagggagaagataaaagtgttattagccacatcatggactattgctgtaaataccaaagggcatcatatacttaagctgaagaactcttagagacataaacaatgaaccaaatctaaggcagacgtaagagcttcctgaaagggttttactgtacattttgtttcgtttgctacatttgatacctacacactcaatagggaggaaaaacaggtttcagaataagccaactgtttcagacttgaaggcctgtgggggcagttggtaatataaaagtaatatgctgcagggtaagataaagactactgaggcctacagctgaattggagagaaataccatgacttaaagacattcaaagccaattaaaaa

SEQ ID NO: 20077 - DNA, 2796 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20078 - DNA, 1388 bp, Homo sapiens
gagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20079 - DNA, 368 bp, Homo sapiens
ccttggctgttacatcttgtcgttcatcacccctaccacctttgcaagattaagattgttaataaagatgttaacacgttctctaggcctcactccaacctcgccatagctggcccgctatctggggccctctgctcaagaaaagaaactgcattttatcataagttctgttgtttaccgtctcctgatggcctggagcttttggctgtcttgcttaaatgtgactcaaagcagttaaaaaataaagaaggaaataaaatgaaaaacaacaacggaaagaagaaaagggcaacctcagcctgatgaaagacttggaagagtgagacctctccctctccggaataaattgctagttgcctttcagtgtc

SEQ ID NO: 20080 - DNA, 2838 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20081 - DNA, 2394 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccct

SEQ ID NO: 20082 - DNA, 2281 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctg

SEQ ID NO: 20083 - DNA, 2772 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20084 - DNA, 2516 bp, Homo sapiens
aggccaggcctacctggggctgggttggagtggtatggtctttagctgttagaaagaagatgaagtgggagaggatggcatggctggaccagaggaagaaattgaggggaagaagggtggcgtcacttgttcaaggtcatccaactgacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20085 - DNA, 2235 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccct

SEQ ID NO: 20086 - DNA, 2284 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccct

SEQ ID NO: 20087 - DNA, 1708 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaaggatggcctggagcttttggctgtcttgcttaaatgtgactcaaagcagttaaaaaataaagaaggaaataaaatgaaaaacaacaacggaaagaagaaaagggcaacctcagcctgatgaaagacttggaagagtgagacctctccctctccggaataaattgctagttgcctttcagtgtc

SEQ ID NO: 20088 - DNA, 2016 bp, Homo sapiens
gatgcgagccggccaccagtcccggcagagccactagggcctctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtgagctgtcttgactgggctgatgctgggctgccaggaaaaagaacacgcataactccggattggcccatgatggcttcctgctgtggcccagccagcactgcccgctttccctctcttgctcctcagcctggcagtccttattagcctctcccccaaaagccaggttgccaaacctctcagccttcaagtgcccatcatacctctgccctcttggtacaacttccctgaattcttcaaaccaagggtgtctcatcaaattgtgcattaactgtgttacaataagaataaactgtgtttatttctagatggcctggagcttttggctgtcttgcttaaatgtgactcaaagcagttaaaaaataaagaaggaaataaaatgaaaaacaacaacggaaagaagaaaagggcaacctcagcctgatgaaagacttggaagagtgagacctctccctctccggaataaattgctagttgcctttcagtgtc

SEQ ID NO: 20089 - DNA, 1139 bp, Homo sapiens
catgagaataccagtgtgtactcatagtacgagaagggaggcgcctagtccggaacgactctcttaattttccaccgctacacatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaaga

SEQ ID NO: 20090 - DNA, 499 bp, Homo sapiens
tgagcttaattgccagaaatgcattccctaagcactgcccccaccccgcaacctgccgctgcaatgtgggagactgcaactgcatgggcttcaattctgagttctgatgtctactggggaggtgatgtaaagcgtcttggatttgcgggtcttccaagaactcaagcaggtggtgttagagtcattactgggcaaggcaagaagtgccaccatcagccccatggacagagcttcctttgggtagtaagtgtttgcctgtcttttcacccactttgtctggctcccagaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccaggtaggcatcctgggcttcagccccatcaggaggctagggagtgatcacactgtagtcttgaagaagagg

SEQ ID NO: 20091 - DNA, 379 bp, Homo sapiens
  misc_feature (326)..(326): n is a, c, g, or t
  misc_feature (334)..(334): n is a, c, g, or t
tgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacatgctgngattacangcgtgaagcattacatccaagtgaaacttcttaagactggtcctg

SEQ ID NO: 20092 - DNA, 551 bp, Homo sapiens
  misc_feature (430)..(430): n is a, c, g, or t
  misc_feature (436)..(436): n is a, c, g, or t
  misc_feature (460)..(460): n is a, c, g, or t
  misc_feature (494)..(494): n is a, c, g, or t
  misc_feature (515)..(515): n is a, c, g, or t
  misc_feature (528)..(528): n is a, c, g, or t
  misc_feature (548)..(548): n is a, c, g, or t
tgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctgggtgacaaaggtagaatctatccaaaaaaaaaagttattatttctgaagattgtatgaaatttataaaagtctgctggccctgatatgatgctgtcagtcatgattctgattactgtcttaaaatgctgcacataagtaattaaatttcaagaaacaaagttcatcagcttctctccnaaggtntttgcccacaatacccagagggcntgtgcagcaatcatgtgtgatggggtgggggggntccaagcagggtgggcagganccagggggcctgnttgaccaggacagacccccnctg

SEQ ID NO: 20093 - DNA, 412 bp, Homo sapiens
tgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgatctc

SEQ ID NO: 20094 - DNA, 352 bp, Homo sapiens
tattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatc

SEQ ID NO: 20095 - DNA, 1831 bp, Homo sapiens
acttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggacctacatgtggtttgcgtaataaaacatttgtatttaa

SEQ ID NO: 20096 - DNA, 2211 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20097 - DNA, 2207 bp, Homo sapiens
acttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20098 - DNA, 2649 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaaaaaaaaaaaaaaaaaaaaaaaaaaaaaaaaaaaaaaaaaaaaaaaaacaaaacaacaaacaaaaaaaaaaaaaaaaaaaaaaaaaaagggggggcgccccaaaattcccccccgcggacgggacccaaacataactataggacgctccccacctaattcgttttaggtaaaaagcagggcgccccagaaagagagcgggactcactatataataacacgacgccgacgacgcaggggcgatttacaacaacacagcccgttggcgagagaaccacaccacgcctcgcacggtcgcactattagtggagagcggccacccccactcttctgggggaggcaacaacaatggcagggccacacccacacggaagagttacaggccgccaggggagaaacaaacacaagcagcgacgtattcttgagacccacacgaac

SEQ ID NO: 20099 - DNA, 2042 bp, Homo sapiens
acttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20100 - DNA, 2000 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggacctacatgtggtttgcgtaataaaacatttgtatttaa

SEQ ID NO: 20101 - DNA, 1264 bp, Homo sapiens
aaaataaactagtagagcgcggttaatcggacgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagaggctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20102 - DNA, 1212 bp, Homo sapiens
acttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20103 - DNA, 831 bp, Homo sapiens
  misc_feature (10)..(10): n is a, c, g, or t
ggcgcccttncctggggtagaggtttttacctgggatcgggccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20104 - DNA, 767 bp, Homo sapiens
gggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctgggtacgttttagccaatcctccccatctgcgctcctgcccggggctcccccagttcccctggtctcaccctgttctgactccggctctgcatcctatctgtttctctgtttctttcaagctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtg

SEQ ID NO: 20105 - DNA, 1752 bp, Homo sapiens
acttccggtcgtgggccatgccgggggcgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20106 - DNA, 1929 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20107 - DNA, 2246 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaatgagttggcattaattctttgagcacatctctct

SEQ ID NO: 20108 - DNA, 1518 bp, Homo sapiens
cttaggtctagagttacgagggactggtttaatcggcgaggagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20109 - DNA, 1281 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20110 - DNA, 637 bp, Homo sapiens
aaaataaactagtagagcgcggttaatcggacgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 20111 - DNA, 446 bp, Homo sapiens
gccgactactactactactaaattcgcggccggtcgacagaattttttgaagactcagattcatcaagttatattatgtcacagaacagaatggacatatttccattttacatacaaaatgatctgcttatttgggagtatctgaattagacaaattctcggccgggcgcggggctcacgcttgtaatcccagcactttgggaggccgaggcgggcggatcacgaggtcaggagatcgagaccatcctggctaacacggtgaaaccccgtctctactaaaaatacaaaaaaaattagccgggcgtgatggtgggcacctgtagtcccagctactcgggaggctgaggcaggagaatggcgtgaaccctggaggcggagcttgcagtgagccgagattgcgccactgcactcccgcctgggccacagagcgagactccgtctcaaaa

SEQ ID NO: 20112 - DNA, 256 bp, Homo sapiens
acactgaagaagtccgtttgtaattgttggtcgcaacactgtcattcttttggagtcttagtgacaggttaatgggtaagatactttagggacaggggacagcccctgtgggccttcaagtcatacccctccctgcctggtgccccttactagctgtggattatccactgtaaaacttgtctcttgggtgggggaagtttgcctggcaacacctactaacacctatatggcgtgcagtccctttgcctgccccagg

SEQ ID NO: 20113 - DNA, 467 bp, Homo sapiens
ccaggctggagtgcagtgacggaatcttggctcactgcaacctctgcctcccaggtcaaagtgattctcctgcctcagcctcccaagtagctgggactacaggtgcccgccaccgcacccagctaccagaagaaaactttcacacagcctacctaagcttatgttcaagagtctctcttgaaatccaggaagaggctgatattccaagagtgatttaattgtgggatcctcctgaagcagatgaataggaacagctatttaaattgatgtaattttattatgacctccttcacagtggttttcaggtaaccctgctttcttagttaataatgaggttctgtgacccaggtaaccttgatgcacagatgagataatgtggggattcactgatgcaaaatcagaggcaatcctttcataagtagaggtgcctctggccccagttgtttagatctcctttggccaaaaaa

SEQ ID NO: 20114 - DNA, 244 bp, Homo sapiens
taacatatgaccaaatgtctgggcacctggggcccagtcaagtcggcacataaaattaactatcacagaagggtgtggaacctgggggtatgagtcactggggccgttagtgtaaccatttgccacaggcagacttgtttgggttataattctttcctgtaaatcttattcatctctgtatccccaatgcctagtatgatctctgacttatagtaggtgatcattaatgtttgttgaaagagcg

SEQ ID NO: 20115 - DNA, 375 bp, Homo sapiens
agagttggttaggttaagtggggatcttgttttgatggaccacccagtattttagacattatctattttttcaatatcgttttcaaagaaataaattatactgaggaaatttaatgtgttactaaagaatagaaaatatactaaattttatttgagggtcattctctttctaaaataatcataatagctattaaaagttttcatgtgagcatattttctttaatttgtttcataagctgttttgtaggaaagtgttacaaaaacatttgtacttggcgtgagcccgggaggcggagcttgcagtgagtggagatcgcgccactgcactccatccagcctgggcgacagagcgagactccgtctcaaaaaaaaaaa

SEQ ID NO: 20116 - DNA, 419 bp, Homo sapiens
gtgtcagagcctttacctggaccttcgcatgaaaaaggaaacagaatagtcaatggacaaggagaagggcctcctgcaaaacatccttccttgaagcctaccactggagtggaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaaaaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgataagtaagcctatagcag

SEQ ID NO: 20117 - DNA, 363 bp, Homo sapiens
ttgcgtcagtggaaggtgaccgggccaggggcctaaggccctggtacatgttaagtcccagctctgcactggccacacaccgggtggttaccatccttcccagagcagccactaatatccccggtgtaaggaccagcacacttacccaaggccatgtggagtgaggagcaggactgcctggcccagaactgccgcctccccaccccaggctgccacctccatgcagacagcctggtcaggaaggcaaatgtgccagtctttgcaggaaggacagagggacttgtgaggcctcgggagtctcagtgacccactcgagagcatccagggacgagtcccgggcagtaaatcagaccgtaatgatca

SEQ ID NO: 20118 - DNA, 259 bp, Homo sapiens
tggattccaagtctttgctattgtgaatagtgccgtaataaacatacgtgtgcatgtgtctttatagcagcatgatttataatcgtttgggtatatacccagtaatgggatggctggggcaagaccccatttcaaaaaaagagaaagaaaattcgtgtagtcccagctgctcgcgaggctaaggtgggaggcggaagttgcagtgagctgagatcacaccactgcactgtagcctgggtgacagaacgagacccgtctc

SEQ ID NO: 20119 - DNA, 106 bp, Homo sapiens
ttccaggcacctgccaccatgcctggctaacaattttagtttttaaaacttaaagaaatgtgtgtgcatttctcatttacaggcttccttcctctattcagcttct

SEQ ID NO: 20120 - DNA, 452 bp, Homo sapiens
aaatcttcaaagagaaatggacaaatacaaaataatactggggagcttgaacacacataattagcttatgacagatcgtggagatgaaaattttttttgtaagtgaagtttaaaaacacctgggaataatacaagtaatgaggttgatgtggggtgtgtgtggctgtgtgtgtgtgtctgtgtgtgtgcatgcatgcataagcctatatgggttaaacttaaaaaaaaaaccctttccaaaagaccatagaaaattttttcatacagctttattcagatataatttacccatttaaaatatgtaaggctgggcacagtggctcatgtctataatcccagcactttgggaagctagggtgggtggatcacttgagatcaggagttcaagaccagcatggtcaacatggcgaaaccccgtctctactgaaaatacaaaatatagccgggcatgg

SEQ ID NO: 20121 - DNA, 349 bp, Homo sapiens
gagctgtggattgggagtgaacactacataaaatttgcagggtatcccaggacacccctcagtctttaatacaaaccaatttagttactctggagtgaaatgacttgtggatacactgttcaaccatgacttcctttatgacaaggagcacttatacatgtttccaaatgtgaattagcccttgaattagtttgaaaactgctacttgaataacttttgaagagaaagattttctttccggtaattttactccctaaaaaaggcaaaatactcagatgttcaatgtgaaattacaaatagttgtttgaagtatatatacttcaataaatagttctttgtgtatataaag

SEQ ID NO: 20122 - DNA, 513 bp, Homo sapiens
ttgctcattgggctatggttatgtaaggtgatgacactgggggaagctgggtgaagagtacacaggaactctactattttacaacttctatgtcagtctaaagttatttcaaaagttaaaaaaaaaatcacctgggaatgtgatcctgccctattaactttggaacaccatcattcccactgccctcaccaggcatgtatggtgagccaggccccatgcctggggggcccatccagttcttacagagccctgggagatgggaccgttaaatgagctaatgtcaagcacttagcacagcgcctgggacaaaggaaaggcttggaaactgttagcaatgttatcacagtgttcccattttaaaatgaggaaacagcctcagagagctgaagtgatttggccaagtcacaaagctaaaaagcagctgacattgggtttaataccacattctccaactgaaaacttctgactacactagactcccctgctgtcatgttgacaaggattatttgtaaa

SEQ ID NO: 20123 - DNA, 204 bp, Homo sapiens
tcactgatttccagtgaacattcatttgtttgctttaaaaaataatctgctaaaaaaatagcattattcccataggatgggtatatctgaatataaattcatgtgcagtgtggctataataaaaacaatcatgaagtactttggagcttatataatctgcaagatcaaagctatattgtggtgtaataaaaaaagaaccaaaaa

SEQ ID NO: 20124 - DNA, 566 bp, Homo sapiens
tctagttcttacacagctaaaaaaaaaccacaacaaatttacaaattaaatacaaatgaaaccacaaaatgaatactattcaattaaaaatattatagtaatttaacgtgacaaatgatgtattttgctaaaactgtcatccgtcgtattgttactatggtgttgcctgctatagctcagcttcttttgtgttcaacatgcctatgccaccaagtgactcctgatatcttaattttctcaccatttttctgttacaactaccaaatagtgcaatctcatgatgcatttggctttcattttgtgcatgaaagtatcattgtcattttaaaaccacctctgttcttttctcattatcccagaacaataaaagcagcactaaaacacacatgtaaatgtgggtgctgaaattgtgtggcaatacttggttgtaaggtggtcacccaaataattcagaatatgcttatacaaatctaaaaaatatgaaaatgaaaataaaattaaaaccctagagaatacattcgcagacataatttgagaaaaactgttcaggtctgctggttcccaaa

SEQ ID NO: 20125 - DNA, 647 bp, Homo sapiens
cgctgggattacaggtgtgagacaccgcgcccagcccccgaatgctgattcttttatctgcttctgtattcaatctgttgtgatatgatgggtagcctctgaaacactccactgtatacttgtgaaagaatgaatgtgaaaaaggaaaatagatttgtagtattattatgcaaattgttttgacctcagagaccacttggaaatgttttagggaacccccagaggaccttggatcatgctttgagaaccgcggctctagatatgttactatttcagtagcatctaagtacatgtggctgctgagcacttgtaatgtggctagtgcaaatgagagacaggacttccagctatatgtaatttaacaaactcaaatttaaaaactggaacctcataaaatgttttgttgttgttgttaaacatgaccttatagttttggtaggaatacatttcactttaacccttcaaaatttagcatttgaattgagatatgctgtatatgttaaatacatgacagattttggggacttagaaaaaaataatgtaagatatttcattaatagtttttatattgagtatgttttgctatgataatatttttgatatattgggttaaataaaatgtattttaaaattaatttaagctatat

SEQ ID NO: 20126 - DNA, 774 bp, Homo sapiens
agtagagacagggtttcactgtgttagccaggatggtctccatctcctgaccttgtgatccacctgcctcagcctcccaaagagctgggattacaggtgtgagccaccgagcccggcccagccatattttttgatagactagtgtcaggctgctgctagtgagactagagggcaaatggggagcacgcctcaggtgagcgagctaaattagaagtgattttgattgctcgacactctgcttgaaggtggaactttgcaaggcttcatctctgatgtactacagaagagagcgccggttcttgccctgagtctgcttctggcagttgggtccctcatcgggtatagtcgtgagtattcttttgcaattactaattcctttgctcccctaatctggttggaataaggcatttgtttggagtcagtgaccagtgctggggagagcctggagaccagcttcaaggcccgatatgccacctttgcattgtcctgtgaatgcctgggaaacctgtcatcacatagttttatttgtcttgggaggaaactggcatctcttttgctttgttaatttgcttaaaagcttgcttgggagtgtatatgctttgtttgggggaggctccagaggcacagcattatagccaataaaacaataaaaagggaacaggtttcaaaagcggaaagatggtaattagtaggtttggtatattcccttaagatgctgctgagacaggagtagagcttttctttagcttttagaagtcttgttagcttgagcat

SEQ ID NO: 20127 - DNA, 599 bp, Homo sapiens
  misc_feature (592)..(592): n is a, c, g, or t
agtagagacagggtttcactgtgttagccaggatggtctccatctcctgaccttgtgatccacctgcctcagcctcccaaagagctgggattacaggtgtgagccaccgagcccggcccagccatattttttgatagactagtgtcaggctgctgctagtgagactagagggcaaatggggagcacgcctcaggtgagcgagctaaattagaagtgattttgattgctcgacactctgcttgaaggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtggggccagtatttagggtctctgatccgggacaacccaggatgtgggacggnggtaccg

SEQ ID NO: 20128 - DNA, 444 bp, Homo sapiens
atctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatctta

SEQ ID NO: 20129 - DNA, 276 bp, Homo sapiens
gttctgctcctgggagtgacatggtcaggtccatgtggctgctccctgggaggctgcagtgaggagggctgcagtgaaaggacctttctcttccttgggcctccattcactctggcatctcaggcaatgactagctctttgagactcagtttcttcctctataaaatggaggcagaaatgccaccagcctcctagggctgctagaggcttgaacgactattgcagggaaccgtgccccacagagccgggtgctgggaagggcagccacggtcatcc

SEQ ID NO: 20130 - DNA, 387 bp, Homo sapiens
tcattttcttctgagaagcagcagtcacagagatgtagctaaaaagacaggacttggggtaattaggagcccaagtggcaaataaaggagtatttgacccattcaagctctgagagtacccaaactcagctcattcaggttgatggagaattggtagagaggcttcttcttaaaagtatctgcaatggaggaatatcccctcaatatggaatttcattccaaacaaattgcagaaatagggaaggattctgtcttataaaaaaaattgcatggtgatgataactgagcaagatatactatggtgagcgctcaaaagaaaaaagctaatgtatatatccaaagactactactattttcaccatccctgacttataattatttgcacct

SEQ ID NO: 20131 - DNA, 342 bp, Homo sapiens
acactaataacacatttgtatgaatataatccaaataaggttaaaccccattcatatttgacaatactattagcctgaagtccaaaagagacatattcacctttgttataataaaatgattttatttgacaacgattttattatatcaaacaagccaaatgtgtcttttttggacttcaagtttacctaatatcaaaaattaatgaggaccgaagttagagtttgattttggaaagttagtcaaatataaaaagcttaaaacacttgatatcacaaaatagaatcacaggttattgtaaaataagtcattcatttagtcaaagtgataactcaaagatttca

SEQ ID NO: 20132 - DNA, 441 bp, Homo sapiens
tgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtaaaagcccta

SEQ ID NO: 20133 - DNA, 202 bp, Homo sapiens
cagaaacaaacaaacaaacaaaacaattgctttatagttcttatccacgatgaatcatttttcttctagattaaaaaagaaataatagattaaaaggaagtaatagagacaaacgagattcaatgttaggtgaaaaggatgaggcatcaatcactctactgttcaatagtgttaacgaaaaaaagaatccattggctgaaag

SEQ ID NO: 20134 - DNA, 478 bp, Homo sapiens
acactctcttcaataaatgctgctgggaaaattggatatccatatgcgaaataacaagactagaccttcacctctcaccctatacaaatacaataaatataaaatcaattaaaatgtataaaaaacctaaatgcaagatgtaaactaacactactagaggaaacatagagaaaacacttcaggacatttgtctgggaaaagattttatgaataagacctcacaaacataggcaacaaaagcaaaaataaacaaatgggattattgcaaatttaaaaacttctaaatgacaaaggaaacaaccaacagagtgaaaaagtaatctacaaattgggaaaaaatatttgtaaactacttatccaacaggggattaataaccaaattatagaagggatgcagacatctcaacagcaaaaaaccaaaacaaaagacaaaaaccaaaaaaaaaaagtcgacgcggccgcgaatttagtagtagta

SEQ ID NO: 20135 - DNA, 392 bp, Homo sapiens
ggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaatt

SEQ ID NO: 20136 - DNA, 804 bp, Homo sapiens
tataccatcatgcatctggcaaacaggacaatgtgacgtccctctgtttcctaattggataccctttatttctttttcgtgcctgattgccctggccaggacttccacatactatgttgcataagagtcatgagtgagggcatcgttgtcttgtgctggtttcaaagtgttttgcccattcagtatgattttggctgtggttttgccataaatagctctgtatgtatttgtgagatacgttccaccatacctactttattgagagtttttagcaggaagggctgttgaattttgtcgaaagccttttctacatctattgagacacattatgtggtttttttaatcgttgattctgtttatgtgatggattacatgttattaatttgcatatgttgaaccagccttgccatcccaatgggtatgaggtgctgtcccactgtagttttggtttgcatttccctaatgattgatgacgttgagcgtcttctcatgttataaactcttcacgtgcttattggccacatctttgaagaaatgtctattcaaatacttgtccatttttgaatttttttttcctgttgctgagttttgagagttctctgtatattctggatcttaattacttatcagatatatgaattgcaaatgtttcctcccattctgtgggctgcatttttactgttaatactgtatttttatgcctaatttttaaagtgttcatgaagtcttgtttgcctgtttctttagttgcctgtgccttttgtgtcacagccaagaacgctgccaaatccaatgtcatgaggc

SEQ ID NO: 20137 - DNA, 885 bp, Homo sapiens
acatcaaaaagggatgaagatggacttgatggtattccttaccactttcctggctggatcacaacaggctgtctaggttgccttatcaaactgaatccgccttggcaatattatcactgagacgctgaaagatttttaacttaaccgactccatcgtgcttctaacctccttgttcgttcagcataggctgaactaactttgagagaaacttatagtttaaaacaaagatgataacagccctttcccaaagcacacctccttcttgcctggggactagattccctttgtaggactaacattagctacaagattagaaattatggtttaagagtcatgcaactggagccttcaagacttttcttcaaatatctcagtgcttgagatattttccagaccctgcacttgccggatcatctggcaccacccagatcgataaactgtctaatctgctcttgtgccatcgatacaccccgctgtttatcgatgccatcccaatgggtatgaggtgctgtcccactgtagttttggtttgcatttccctaatgattgatgacgttgagcgtcttctcatgttataaactcttcacgtgcttattggccacatctttgaagaaatgtctattcaaatacttgtccatttttgaatttttttttcctgttgctgagttttgagagttctctgtatattctggatcttaattacttatcagatatatgaattgcaaatgtttcctcccattctgtgggctgcatttttactgttaatactgtatttttatgcctaatttttaaagtgttcatgaagtcttgtttgcctgtttctttagttgcctgtgccttttgtgtcacagccaagaacgctgccaaatccaatgtcatgaggc

SEQ ID NO: 20138 - DNA, 821 bp, Homo sapiens
gtcaattcatcaataaaaatgtaaaaattataaacatgcacccaataagaaagcccaaaaatgtaaacgttggcagaatggaagggacagacaacaaacagttctatctataataagagttggagacttaaacacaccacttaataatggatagaccatctagggttgggagcggtggctcatgcctgtaatcccggcctcccgagtagctgggattacaggcatccgccaccatgcctggctaatttttgttttttgagatggagcctgggcaacaaagtgagacacatccaccctcaacaaaaagtcgttacaagagacagcattatatatggataaaagagtcaattcatcaataaaaatgtaaaaattataaacatgcacccaccaccacgcccaggtcaacctttttttaaataactgccatcccaatgggtatgaggtgctgtcccactgtagttttggtttgcatttccctaatgattgatgacgttgagcgtcttctcatgttataaactcttcacgtgcttattggccacatctttgaagaaatgtctattcaaatacttgtccatttttgaatttttttttcctgttgctgagttttgagagttctctgtatattctggatcttaattacttatcagatatatgaattgcaaatgtttcctcccattctgtgggctgcatttttactgttaatactgtatttttatgcctaatttttaaagtgttcatgaagtcttgtttgcctgtttctttagttgcctgtgccttttgtgtcacagccaagaacgctgccaaatccaatgtcatgaggc

SEQ ID NO: 20139 - DNA, 283 bp, Homo sapiens
acctcccgggttcaagcaattctgcctcagcctcctgagtagctgggattacaggcacccaccaccacgcccaggtcaacctttttttaaataactgccatcccaatgggtatgaggtgctgtcccactgtagttttggtttgcatttccctaatgattgatgacgttgagcgtcttctcatgttataaactcttcacgtgcttattggccacatctttgaagaaatgtctattcaaatacttgtccatttttgaatttttttttcctgttgctgagttttga

SEQ ID NO: 20140 - DNA, 3333 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 20141 - DNA, 162 bp, Homo sapiens
gcggccgcctactactactactgctcgaattcaagcttctaacgatgtacggggacatgacttagggaggtgggacccacccacccccatccaggaaccgtgacgtccaaggaaccaaacccagacgcagaacaataaaataaattccgtactccccaccca

SEQ ID NO: 20142 - DNA, 3624 bp, Homo sapiens
  misc_feature (3343)..(3343): n is a, c, g, or t
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccacccaaaaaaaatanttataaaaactccaggtgggggcccgttctccattcttcctaatacaagttcacttaccaattacttggccgctctttacacagttcggaatggtgaaacactgtccgatctccaacttaaatgctcttcatgaaaatctcctatttccaacttgcttatattcaaaacagcccgtaccttttgcctttccaaattgtgcccaccactattgctaaatgcaaatgtggacacttcctatttcgtattctccttaacattttcttacttctattgtacctcg

SEQ ID NO: 20143 - DNA, 4293 bp, Homo sapiens
  misc_feature (3746)..(3746): n is a, c, g, or t
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccacccatcacaaaaaaaaacaaagcaaacgacaaaaaaaaaacattggtggggcggccttcggccacacgaaaaagtttataaaaacacaaaaggtgggggggggggcacccaaaaagggaaagataaacatggacgcaaaacaggctagacgcataggaggacacctcagtggtcactagacaaaagggagtggggtatctacaccgcaataaaaaacacgcgctcgcgggggacaaccggagagtgttcgcttgaaacacaactaccacgaagtgggagttccagacaggagccaccagcaggagccataaacacaccagggagagtcacaaacggagaaggcgtcggtactataagaaagataagcgccccggcgcgcgtagatgataacaaagcagtatcgagcaaaacgaagcnccaacgacaacacgacaaacgtaagagaatcagcaaggaaaagcaagaacagagagacaggagagcagagccgagacaggaaagtcaaaggaacgagatgagcgagagcgaggagacggacgagtaagagcgaagagcagaggagagatcgagaagaagaaggagagagaaggaggtgtacgaagagagcgaagaacgaacaaagagagagagagcagagagagaagagagcgaagaaggatgagaagaaggagagaggacgagagcgaaggacgagagacacgacggagagagcacgagaagcagtgggagccgagacgtgaaggaagcaaacagatgaagtgcaaacaccagtagcacgataaggaaagaagtaggaagacgatgaagacgaagagagagagcgacggagtgacagaggagcagaaggagcacgacaagagacgaagagacacgatagggagagagagagagagcaagggagagaggcagtagagcagagagacagctagggagcagacagagcgatagacagcatagaagaggt

SEQ ID NO: 20144 - DNA, 1932 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcagcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgacttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 20145 - DNA, 1342 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgaggtacggtcctgagtctgtggggcaggacgggaggtagtgccttcatgcctagccccctccccactccacccccattcacatgcctgctgtccccagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgtaagtcagcctgctcctcggttcagctgggtgctttcactcctgctggggctcaggggctgtgggacctaggtcggggagccagccctgcacaaatgcagcccaggcttgagccagggaggtggaggctgcagtaagctgtcatcacaccactgctctccagcttgggtgacaaaacaagacccactctcaaaaaaaaa

SEQ ID NO: 20146 - DNA, 285 bp, Homo sapiens
cgcaaggacctgggtcgctctgagtccctccgcgtagtctgccggccacaccgcatcttccggccgtcggacctcatccacggggaggtgctgggcaagggctgcttcggccaggctatcaaggtacagagcatgccagggtctcaggggacagtctgggtgggacccctccatcctccttccttcccagtctatggaaacacagtggaaggggtatctggcttccagactccctggccagtgccctctcctcccttggcctcctggagctaattaggaacaggg

SEQ ID NO: 20147 - DNA, 3263 bp, Homo sapiens
gcgccgagccggtttccccgccggtgtccgagaggcgcccccggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 20148 - DNA, 3272 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 20149 - DNA, 3422 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccacccatcatagaaagataatggccgccttttaccacgttggactgggccctggtgttaccaactttcggctggccacattccccttttcggcgt

SEQ ID NO: 20150 - DNA, 1149 bp, Homo sapiens
agctcagcccctgcagtcatctcagagccccttcccgggcctctcccccaaggctccctgcccctcctcatgccccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 20151 - DNA, 1246 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgtaagtcagcctgctcctcggttcagctgggtgctttcactcctgctggggctcaggggctgtgggacctaggtcggggagccagccctgcacaaatgcagcccaggcttgagccagggaggtggaggctgcagtaagctgtcatcacaccactgctctccagcttgggtgacaaaacaagacccactctcaaaaaaaaa

SEQ ID NO: 20152 - DNA, 691 bp, Homo sapiens
gaatttcctgggaatggatttcagaatcattcctaagattaactgtaggaggtttaaaactctgtgcaaatgtgcacgtttgctatgtgtgtggaatattctttaaaaatataattgaaaattttctttattctgaaaaagtgaactgctgtgatttaccttgatttggctgaatgaagttaataaattggatagctccttaagggctttattctcttggtaattgcctacttgtgtggatgcacattttatctagtttgaatttgtttcaaaggaacattattttgtaaataaaatatatattttttcccatgtggtattgcatagcacatggagaaaatagattgatgataccgtttcattttatgatttttctttgaatataatgttttgttcttttattggaaataaaactgaccccaagaataaaattatatttccttttaattttatgatagtgcatttaaagtaatgtatatctacccaaggtgatgaagatgatgattgccaaccacaatttaatgacattaaagaaattaatgagttttgattcctttgcttatcttgtgtgttatagtctaactccttttaaatctgttctttgacattttatatgactttcagattgtgtgcgtatatatgatacatataattatgtattaaagtatgttaattaaaaatgttaattaaa

SEQ ID NO: 20153 - DNA, 573 bp, Homo sapiens
  misc_feature (195)..(195): n is a, c, g, or t
  misc_feature (386)..(386): n is a, c, g, or t
aaaatatatggtctaggtacgaggctgggtttaccatgttgtcggtagcagccctgctcggtgcccgttcgcgcccgtcctgtcggccacgtccgcggggttgcgggcgcgctgcggccttggtgcaggccacggtgcccgccaccccggagcagctgtgttggacctgaagcggcccttcctcagccgggagtngctgagcgccaggcctgcgccgcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactnggagtaactactgtggggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtacgtcatagaacc

SEQ ID NO: 20154 - DNA, 492 bp, Homo sapiens
  misc_feature (14)..(14): n is a, c, g, or t
  misc_feature (36)..(38): n is a, c, g, or t
  misc_feature (51)..(51): n is a, c, g, or t
  misc_feature (114)..(114): n is a, c, g, or t
  misc_feature (305)..(305): n is a, c, g, or t
gcggctgtcgcatngttgtcggtagcagcccgctcnnncgtttcgcgcccntcctgtcggccaccccggagcagctgtgttggacctgaagcggcccttcctcagccgggagtngctgagcgccaggcctgcgccgcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactnggagtaactactgtggggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtacgtcatagaacc

SEQ ID NO: 20155 - DNA, 284 bp, Homo sapiens
aataagatttatgtaacttagacaattgcagaaattaaacaatatctgacatattaagttgacaaacatggtttaaagtgtttgaagatgttgaattaacaaagtttataaatgggaccaaaattattaaacattttttaaaagtacttaaatgtgatacacttatcaatagaataacgtgtaatctgaaatttaaagtttgagaactagttttaaatttgtaactttaataaattgaacccttccctcctctaggaaaataaaagaatacctatgtaaaagga

SEQ ID NO: 20156 - DNA, 438 bp, Homo sapiens
ttaaaatacaaaacagccacttagatttgagaactatgctaagtgctttgcaggcagtatctcgtcttgtttcagaataaaaggtgaaagactgtttctaattcatccatggaatcatactgtagtttcaatgtatgtatatcttaaaaattttattgtgtaaatatttaaatatgtaagtatttaattcagatgagttgatactcccagcgttcccaaatattgttaggggccagtgttaaataataactattttaccagaattatgaaaatatttgagaaccataagattttgtttctttgctcaaaaaactaaggggcctggcacaatggctcccgcctgtgatcccagcaccttgggaggctgaggcaggtggattgcctgagccgaggcattccacgaccagcctggccaacaaggggaaaccctgtctccac

SEQ ID NO: 20157 - DNA, 339 bp, Homo sapiens
tacaccagatttgctaaagcctaagactagtctcaaaaattcatttttctattaatcagaccacacacacacagagagagagagagagagacagaaagacagagagacagagagacagagaaagacagagacagagacagagagacagagaccagaagcttggctggtaacaaattcttaccccttttgccagcataccacgtttctgggttccctttctctgcagcttccagaagaatgaagtggcttttgatgaccctgctcattgcaccatagctttgggggccaagccactttacaaaagaaaattatccttttctgttttataaaactataggc

SEQ ID NO: 20158 - DNA, 253 bp, Homo sapiens
aaggaacctagccgaggtcacgtggtgatctgggagagaagcaggaagcagaacacagtctctggattctcagctagtcctgctccaccagcccagctgggttcctaccggacacttctcttcccgtgacttgtgctcagactctgccagcttaacacaagggaacgatgacaacagctcaccgctgtgctcctaacacctgcccccaactgcaaccagccctgctggatgtggccagaggcacaagctcagc

SEQ ID NO: 20159 - DNA, 406 bp, Homo sapiens
tgtatgtatatatgaatactggatattgatttaagcaaaatgttatatttaactctattttggggatgggagtgggatagaataataaaagaatgctgcctcatttgccctaagagcaagtctacaaataatatcttgactaataatagcaatataagcatattatttagcagtacacaaagtaaatgttataagagatggctaagagtttaaatttgttttctatagaaacagtatatgggagggggctaggaattgcagtttttgttataatctctaatagcatgtctttttttaaactgtccacatattaacattattttggatgatataaaataattttttaaaaatcgtgcatagataatgtacaagtgaaagagaagccagtgattttagcatacctcta

SEQ ID NO: 20160 - DNA, 433 bp, Homo sapiens
ctcgagcagttcttttaagggaggagaccacccctcgtattgtcttattcccaatttctgcctcagagaaaaagtaggagttaaagaaaagacagaaatgaaatcagcagtcaaacagccccatgctgcattccaggcctcgtagttaaagatcgacccctgacctaaccggttatgttatctatagattccagacattgtatggaaaagcactgtgaaaatccttgtcctgttctgttccattctgattacaggtgcatgcagcccccagtcatgtacccactgcttgctcaatggatcacgaccctctcgtgcagactgccttagagctgtaagcccttaaaagggacaggaattgctcacccagggagctcagtttttggagacatgagtccgctgatgctcccagctgaataaagccctttccttccac

SEQ ID NO: 20161 - DNA, 219 bp, Homo sapiens
aagtagagatagggtttcactgtgttggccaggctggtcttgaactcctcacattgtgatccacccgcctcggcctcccaaagttctgggattacaagcgtgagccaccgcgcctggccgtgtgtttgagattcctagagacattagtaaaaccctccaaaagagtggggaccttacaccagcctgccggttcaagctccatactggacctccacctcc

SEQ ID NO: 20162 - DNA, 327 bp, Homo sapiens
gaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatc

SEQ ID NO: 20163 - DNA, 4418 bp, Homo sapiens
  misc_feature (130)..(130): n is a, c, g, or t
cgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccngacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctggggtgagccaatccaactgatcctgcacaagtctccctgctacctcctgctgggctgctcctggttgactacatatttggctctctgccttctcttcatgttggcctctgtgtactatagaccctttggactttagttacaagaatatggcatttatgatcatgttcttttgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttcaaaa

SEQ ID NO: 20164 - DNA, 2667 bp, Homo sapiens
  misc_feature (130)..(130): n is a, c, g, or t
cgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccngacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccagactgatgggcgggctggtatgtgtggacatgtgttcactgtcattatgctgtggctccagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttcaaaa

SEQ ID NO: 20165 - DNA, 770 bp, Homo sapiens
accagttacggaactctcacttctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttcaaaa

SEQ ID NO: 20166 - DNA, 4074 bp, Homo sapiens
  misc_feature (130)..(130): n is a, c, g, or t
cgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccngacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctggggtgagccaatccaactgatcctgcacaagtctccctgctacctcctgctgggctgctcctggttgactacatatttggctctctgccttctcttcatgttggcctctgtgtactatagaccctttggactttagttacaagaatatggcatttatgatcatgttcttttgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttcaaaa

SEQ ID NO: 20167 - DNA, 1361 bp, Homo sapiens
  misc_feature (130)..(130): n is a, c, g, or t
cgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccngacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctgggggccccgaccctgcatccctctcttccttcttttcctccccagctgacaccgaggtattctcccctgccgcccctttaatct

SEQ ID NO: 20168 - DNA, 561 bp, Homo sapiens
cactcattatcttcttacacatcttgaatttacagcacgtaacatttcctgagatttaggttacagctagaatacacagctgttatttctggcttttatctcccaccaaaatgcaagctccatgaaggcaaggactttgtcttattcactgctgagtttcagtacctggaacagtaactggcctataaggggcacttaaaaaagatttgaggagtggatgcatgatagcaaccactgaaaactataacccgacttggaaggggcttggttttgcaggaagccaacctgggattcataaccaggcatgaggatggggctgggggagggttagtcaatacaggaccctgtgctaactctggggtaaggtatggctataaaacagagcagccctaccgtggttctttacaaggttggtctaagagttatttcactttgggagcctcccacacaagggtgacttgaccaaagttctcagcaggggataacaggatgcaggaaactccttggtcaccaggagaccatagctgagcttcccaagcaggctcagaagccttcaggcag

SEQ ID NO: 20169 - DNA, 552 bp, Homo sapiens
caagtttccctcccctctgtgaccgagactaagtctagcacacagcacttgggccagcaaatcctggaaggcagacaaaaatgagaacctgaagcaatgcttacagtagatgtctcacacagaacaatacaaacatgtaaaaaatctttcaccacatattcttgccaattaattggatcatataagtaaaatcattacaaatataagtatttacaggatttaaaagttagaatatatttgaatgcataggtagaaaagtatcatattttaaaactatgtatatttaaatttagtaattttctaatctctagaaatctctgctgttcaaaaggtgggcagcactgaaagttgttttcctgttagatgggcaagagcacaatgcccaaaacagaagatacagttaggaataaggggccttgaatgtcatgaaggcttgaggtcagcttacagataacaggattattaaaaagatgaatttccacttccaaagtctttcattggcagatcttggtagcactttatatgttcaccaatgggaggtcaacatttatc

SEQ ID NO: 20170 - DNA, 290 bp, Homo sapiens
ttttttttcatattcatcaatatctcattcagtagatcttttcttcttgacttatgagatttagagaattcatctgaaagtctattaaatccttcttcagtgtctccatttagcttctctttcattttaatttttttggtcttgggagcatccaggtaatctgtaacaccattttctcttgtttctgatttctcatctgagtcataatggtggcttgacttccttctgtcactccagcactgtgtaatgtattttcagcttatcttgtttaaatcttcgtaaaaaccata

SEQ ID NO: 20171 - DNA, 414 bp, Homo sapiens
actctgctctttaataactgtgtgacttaagactggttacttcacctctgagtctgagcttcctcatctctaaaatggggatggtaatagtagttcctacctcagttcctgacatatagtaagagcttaataaatatttggagatggaaaaaactaatatcttgaagactaaattaaataatggacattaggtgctaagcacatcctaagtgttcaacaagtattagttattaggtgttagttattaggccccagttgtctgtttaatgaatcagtgccaacctttaggttattactaaagggctgcatacttaatcctatcccctttttacatttttattaatgacttaataaaaacaagcatgactccaaatttctagatgatagaaagctgaaaagagtaacaggagatac

SEQ ID NO: 20172 - DNA, 430 bp, Homo sapiens
tctttatcccaatctgagattctgtaatgtttggaagccaactcaatctacatatcgcacttgattgataactcagtgcactataaacaggctctactggcatgttcatttcatagaattcttaggttctccttatctgaggaagacacctcaaaatggaacaactgacaccctacgagccccagatccctgtacttccccttttgtaacactcatcagattttaaattacttgtgcttattacccactaagtcctataatattatgtaccatatctgtcttaactactcctagaggcacagtgcctcttcagattatgtttgacactttcagtgtgctctaaaagcatttattaattgaattagataaatgagtgaatcttgattctgctgccttttctttcttaaaagggaatctgagccctttatat

SEQ ID NO: 20173 - DNA, 332 bp, Homo sapiens
agagaatagcaaatactatatactaatgtaattgcaaatttatatgaaatggccaatgttgaggaaattacaaattatcaaaattgaagaagagttaagaaacctgaatatactgctatagtgaaaaaactgaaaaaattaggaaaagaccacctaaaatgacctgaggcccaaaagcttttgctgagtaattccaccaaacattaaagaggagaaaatttctacattatatgaagtgtgctaggaaaataactcatctcaagttatttaaagctaggaaaataactcatctcaaaagggagtattatttttgacacaaaaattagtgtatt

SEQ ID NO: 20174 - DNA, 895 bp, Homo sapiens
ttagatggagtcttggctctgttgcccaggctggagtacagtggcacgatctcagctcactgcactctccacctcctgggttcaagcactactcgggaggctgaggcaggagaagggcatgaacctggcaggcggagcttgcagtgagccaagatggcgtcactgcactccagcctgagggacagagcaagactctgtctcaaaaaaaaaagaaaaaaaagtggcacagatcaattataaatcacggcttcaaggccagtgctctcacttggtacattaataatctcaggcccaaataagataagtgatatgtcaacgtatgttcactttggtctttacatggcagctatagtatacggaatattataagctcagatcgtcatagctacataactcctttagttggaagatcacgcgtaaatgcccatcaagagctagcagttctgcatttgactcttgaagaccgtggcatggcagacaacacttcttgagctgtaacaggtggacattaaatccatgacaggaggtagagacggccagattacttgagcccaagagtttgagaccagcctaggcaacatggaaacaacagttccaggccaggtgcgatggctcatgcctgtcatctcaacactttgggaggctgaggtggttggaccacctgaggtcaggagttcaagaccagcctggccaacatggcaaaactctgtctctactaaaaaatacaggccgggtactgtggctcatgcctgtaatgccagcactttgggaggctggggcaggcaaatcatgaggtcaaaagattgagaccatcctggccaacatggtgaaacctcgtctctactaaaaatacaaaaattagccaggcatggtagtgtgcgcctgtagtcccagc

SEQ ID NO: 20175 - DNA, 934 bp, Homo sapiens
ataacttcagaaactaaatctgaataaaaacctatgtgtaaacgatcatatagatggctgttagcaaagtggtacttttgtcaactatagtatagtatatttgacacgtttaaaatgtacagtttcataggttttaagatacatatatacacaggaagccatcatcacaatcaagatagtgaacataacctaaatctccagaagtccctcatgttcctttgtgatcttgtctcctgccccttcataccgtccatccccagggaaccattgcattctgtcatgagagattagttttgcactttctaaaattttgcataagtggaatcatacagtagggacccttcaggagtggaggagggctggcttatttcagtcagcataattgagattcatccataaagtagcaagtatcaatactttttattatatattgattgtggttatcccacagtttatccattcacttattgatggacatttgaattccagtttttagaaattacaaagctgctaagaacattttagtacaactcttggtatggatagatgctttcttcttgagtaaatacctcggagtggaatggctgaattgtaatggatatgtgtgtttatctttcgaaggaaacaacagttccaggccaggtgcgatggctcatgcctgtcatctcaacactttgggaggctgaggtggttggaccacctgaggtcaggagttcaagaccagcctggccaacatggcaaaactctgtctctactaaaaaatacaggccgggtactgtggctcatgcctgtaatgccagcactttgggaggctggggcaggcaaatcatgaggtcaaaagattgagaccatcctggccaacatggtgaaacctcgtctctactaaaaatacaaaaattagccaggcatggtagtgtgcgcctgtagtcccagc

SEQ ID NO: 20176 - DNA, 454 bp, Homo sapiens
tgctcttaaataccctacaatgcacagatggtacctccattcccatccccagctctgccctcatgcaacgaagaatgatctggcccaaaatgtcaatagtgccaaggttgagaaactctgtgctggaagagattgccccaaactggattctaaaagaacttgagttggcgtcccagatctgtggattctgtgaccttgagtaagttacttatctctctgatctcttctgaagtgaaaagtgatcaaactgtctgggtgtgagaagaatataaaaggatatatgtaaaatatctggccagaaataagttcaatcattacttttctcccttcttttccctaacaaagtgtagtaaaaggctctgcctcaaagtgagttctgagagaaaggagttttgaagtactcatatttttcactgatttggtaatatctcaagattttattacttgcctgttt

SEQ ID NO: 20177 - DNA, 297 bp, Homo sapiens
agacatttgatgtcagttttcagaatgagattattttttctaatttttaccagtcaagctttgctagcaggaactgagaacattcagaagtctgcctccaaaggcaggaagtttacctagtttcatctgaatagggtgcaaggccatgccaaggggaagtatttgcattattccctagcagaacctcgtacaaggctgccaactccatccgcctagtgaggatacagtgatattcaggccaaattgaatttcttcccccggggaagattattttgctcctttgctctctgttttgtt

SEQ ID NO: 20178 - DNA, 671 bp, Homo sapiens
atggcatgtcacccagtagtactaaacttaagataacatgcaggtaccttttgattcctttcctgactgctgagtcactctattgttgcagaccattagaccggacttcactcacatactccacgaggaaattcttgaaggtttgttctgtccaggaaccttcaattctgtagcagtggcctcagtttcacagcacacagctgccccaccctaccacgcattcagtgtgctgattgagagggctggaaaagcagggaccgtcccctaatccctaaaacgtcttgttgggtggactctgctagcaaaagagttgtcattcccagtcatgctctggaaaggaggtgctagtgacctgatggggcatggccacagcacccttcactgcctgccctcaaggggccagcaccacctggccggccagtctctccacacgctgcttctctttttacgtttaaaaaaatgatttaaaagatgatgtcagagcaatggtgaagtaaattgtggagggaatgaaaacacccccaccttgaaatcctagcccaacccgtttcatttctgtaagggactctgtccctgtgtttcctcagcacgtttcccaaaacatgtgacccagagtgactcggggaatttctgaattatggaagtagtactaaaaaatatttacattgcag

SEQ ID NO: 20179 - DNA, 332 bp, Homo sapiens
gagggacaagatctttgtgtatattttaaattttgtttagttagaaaatagtaagttgccttttagcctagccccaaaactcatttgtgaagtggacatccatttaaaatctagctccatttagcccccgattacagtggcttgccttgtcaaacctcctgctcactagtgggatcctcactcagcaaatgtttgttgagtgtgggccaggcacgatggctcatgcctgtaatcccagcactttgggaggccgaggtgggcagatcacttgaagccaggagttcaagaccagcctggccaaaaaagcaaaaccctgtctctactaaaaatac

SEQ ID NO: 20180 - DNA, 337 bp, Homo sapiens
taaaagccctctttaaaaaaaaaacattacaaatattttactcatatatctttaaagttaaagactaagggctgggtgtggtggctcatgcctgtaatctcagcactctgggagaccaaggcgggtggatcatttgaggccaggagtttgaggccagcctggccaccatgtctactacaaatacaaaaattggccaggcgtggcagtgcgtacttgtaatcccagcttcttgggaggctgaggcatgggaatcacttgaacccaggaggcagaggttgcagtgggccaagatcatgccactgcactccagcctgggcgacagaatgactcccatctc

SEQ ID NO: 20181 - DNA, 396 bp, Homo sapiens
tcgatttttttacattatttggacattatgactttttctataaaatagtaagaacattaaaatgtaagacgcataatgaaaatacaagtggagaagctgtttgtagtaaaattcctattaagtaatgtataacgtaaatgttcagagcaatactttattatagtgacacaaagaaataattaaaagtatattaaaataaatgagtatattactttactacttgtacttttatgtaataaaatgcagtgcattttaaaactgttagggccgggcttgatggctcatgcctgtaatttcagcactttgggaggccaaggtgggcagatcacctgaggtcaggagttcgagaccagcctgaccaacatggagaaacccagtctctactaaaaatacaaa

SEQ ID NO: 20182 - DNA, 335 bp, Homo sapiens
aacttgtctcaaaaaaacaaaaaaataaaacccctcaacagtaagaaaatgaacagcccgatttaaaaaaaaatgggcaaagccaagtgtggtggcttacatctttaatcccagcactttgggaagctgaggtgggaggatcacttgaggccaggagtttgagatcagcctgggcaacatagaaagatcccatctctacaaaaaataaaaagcttagccaggcatggtggtgcacacctttagtcccagctttttgggaagctgagacaggaggatcacttgagcccaggagttcaaggctgcaattagccatgatcgagccactgcactctgcc

SEQ ID NO: 20183 - DNA, 777 bp, Homo sapiens
ggagctttactttcttattttcctaattggaacaaatgctaattgaaacaaatggatatttaaaaatgtttgctttgttctaatttgtatttttatggagaaaggcaatttttaaatatgtaaataatgatgtactttcctaagctgccagctaacttcaagtcactggaaagctttggttcctaagttagtgggtgataaaatcagtacctattttactagattctcacatcccttttcaaaacaatctccattgacctatgtacaagaggtaagcaaaacaatgtgcacaaagattaataggttgtaatgaaatgatagaaattatagaaatgttatttttaatatttcaattaatatcttataaagtaatgcacatttatgttagaaaatttaaaatacaggatatataataaagaaaattaagagtagtcataatcctaccttttatttaatagcttcaactattagatttttagtatatttaaggaatctctcaaatatatatggttataacatatatagtgcatattatttgtactttaattaatattagaataaaattataaatgcagttttacatctaatttgttttattttattcagaatttcccaccatattaaatgtactatagaaagtgaacatttcatcataaaataatttatttaactaatactcatttgtgattggccacttccagtttttcacaaccgtagcaaagaataaacttgtaattcactctctatgtacatccttgtttcctcagcataaacttt

SEQ ID NO: 20184 - DNA, 491 bp, Homo sapiens
ggttaacatgcgggataataaaatgtattagatcatctactactattaaggtccagttccttcaaatttgttacatgtgcattaaaactgatcctattctgtatcacatctagagaaaataattttgggtgatcaatgcagatgaaagccctgcaaagaactacttcaaaagagaaaagggcactttataaaaatacaacaattccaaaaggcttagtgtaattttaagctttgatacttgtagaagtatcaatgctacaaatatttacaaagcatcactgaaaggtttgttatatttcttttacctttatttagttttgccattttttagagtgacagggtctcagtatgttgccaaggctggagtgcaatggctatttccaggcacaatcacagcgcactgcagcctccaatgctaggcctcaagtgatcctgccatttaagccttatgagtagctgggactacaggcatgcctagctcctgaatatta

SEQ ID NO: 20185 - DNA, 452 bp, Homo sapiens
gggatttcagttaggagatttgggtgaggacacagagctaaaccacatacataacccataaaggataaaattaggggagctgtgagatggtcatagaagggatattttatcaaaaattttagagatttgtagtctaaggattctatggtctttactggttgaagtaaaactcccaataaaaacgttttagtagcttctttgattctgaatatttacaaagtgagtctcctttgaaatatgttagacaaaggcagggaaagacctttaaattaaccaacactctagctttttcctataccctggtttctgttattaagatttttttcctccaaataatcattttgctttgtaatcccaagagaaaagataggcaaaaatgcatgccccaaaactcttatagatcagcgtatctcagagtaaaatccaagatacctgtgtgagaatcccctgat

SEQ ID NO: 20186 - DNA, 331 bp, Homo sapiens
tattcataaaatcgaccttgttataagaataagaaatctgtggccaggtgcagtgactcacacctgtaatcccaacactttgggaagctgagacaaaaggatcgcttgagcccaggactttgagaccagcctgggctacagggcaaaatgctttctctgcaaaagatattaaaaaaaaaaatagctgggcatggtggcacgtccctacagtcctgactagttgggagactgaggtgggagaattacctgagtccaggaggttgaggctgcagtgagccgagatagtgtcactgcacttcagcctgggtgactgagcaagactctgtctcac

SEQ ID NO: 20187 - DNA, 358 bp, Homo sapiens
aagaatttcttaatttccaaatggcagaagctgtagagatgttttgacgctttttagaaaacagtaaagcatataatacttcacatgaaggtttatcttgaactacttttccagtcttccttctttcttgttatatttgactttcagaaattttaggtgagatataaaaagccttataggagcagtattcagcaaagtgtgtttaaccaactttgttacatacaccagttctttgctttaaaagaaatagtgttttgtttttcttaaaagcttttattgagctataatttacatgtcacactattcacacatttaaagtatacaattcagtggcttttactatgttcatagagttgtg

SEQ ID NO: 20188 - DNA, 477 bp, Homo sapiens
acacaaaaatgcacaagtttgacatgtcccaagtaaccaaaggcagtgcatttcaaatttatacctgatgaaatcacaccacttaagaatttaacagatctatcaacattgcaccagaccatatgtctacacagatctggccaggtgtttgggttgaataggagtttccgtagtagaagaaatttgagataatagaagagtcttgtcccaccttaggaaagttgcctaaactctctgcacatctaaagaactctgaaagatggaaggaaaatgctgacttcagtctgacaaaagggtacctagaaaaaagtcaaagcatgcaaccaccatgctctgaaagaaagtcaggtgatgggatgatctgtgtggcaaaccaccgtgacagtgtttacctatgtaatgaacctgcatgtcctatcctgcacatgtaacactgaccttaaaataaaagttggaaatcaagaataaaaatttaaa

SEQ ID NO: 20189 - DNA, 365 bp, Homo sapiens
gccaggcacatgcttcccatgcgctaggtactgttttgtgtgcttatatatattaacccatttaatcttaactcatttaatctaattaacccatttaatctaatattaacccattaatagatgtcatatgcctgtttaatctgccaagaacaaagccaagggcatttctttcatattcttactccttcattcaatcatttgcccatttgtccaggcttattgagtgtttgctgtgggtaagccaggcagaattctaggttttggtgatcccgtggtgaacaagccacagttcccgccctcctagagcttctattctactggggcaggagacaatgaatttaaaaaaaaaaaaaaaaaaaaaaaaa

SEQ ID NO: 20190 - DNA, 522 bp, Homo sapiens
agagctagatctggtcataaaacaactcgaagttgtttactggaaagtttaaatacttgaatgtaattattcacatagttatttctatttggtttattctgatactgctgtataatgacctaacgtgacactaataggtcattaatgtaactgatataatagtatatgtatttttcatcgacttaagtcctgtataacaaattacattttaactaatttgaaatttaattcaactcattttaagcgttagaaagactgttttgtgaacctgtcaattgtgtaaaaaatgtattgaggtaatatttatattgaacaaaatagatacaactttaaattataattaggaatatttattgagaatttttgctgcagtttgtgtccgagattcatttcaatattgactgacttttgagtgcagtggatcccacctgtaatcctagctactctggaggctgaggcaggaggatctgttgagcccacgagtttgagaccagcctgggcaacatatcaagaccccttttc

SEQ ID NO: 20191 - DNA, 890 bp, Homo sapiens
agtgacctaaacttttgaaggctgaactctaaagcagcatggtttcccaccaagatattcaagccaaaaattaatccttgcctttcaatataatcacttctaatttcatgccttttggtataaccacacttgatgaatgcttcatttcttgccttggaaagccttgacctttcatgactgtccacaagccatgattgaccaggaactctttgggagcctcccattgcacaacactaccacaagtagaccatgagtaggacattattggttggaggcatcattggtctcataaaatgtagacaaaaatctccagggatattcttctacctttctaaaaaaagtaagcaagcaaatggaaggtgggccagaaacagccaggatccagactgtctgatgataataagacaaggcaagccagagctgctaggaggtggcttggacagcaggtagcagaatgggacaggattgtctcatgccagatttttgtaacagcatcattgtaaggttattgaatagcagagaggtagtatgttgaactcttacttccataaccctcaagagaaatgacatggtcctgagtctgggatacaaaattctattaaatgtttaaatcagtagaggatgcagttaggaagatgagcaaactcctcaggaataaaagactgtttaaagagaaggaaaataaatggaaattctagaaaagaaaaaatatatatagatataaaaaagaaattaaacagtagcttagtagtaggtaaatagcgtaaacaaaaagaactacacctagatacatcttaatgaaactgcagaaaatctaagaaaagatcttgaaagcagccagagagaaaggacagttcatcaaaggaacaacagaatgacagaagaattct

SEQ ID NO: 20192 - DNA, 587 bp, Homo sapiens
tccaacccagaactggtccctgcttccttagagtcatctcaggcacaagctcaaatgcagtgagaagccactcccatcttcctgtcactaagatgcccacggttcttctgcagtgtcctccctctcccatctcagcaagctaaagaaacctaactctgagcacgagtgtgttctgggtggtcttggatcagcagacattaacataaattctttataaatgatctatgcaataccaatatgttacgtacattatataagagacacacaaataaaagtttaaaaggttgagataaaaatgaatagaggtcgggcgcagtggctcacgcctataatcccagcactttgggaggttgaggtgggcggatgacctgaggtcaggagttcgagaccagcctggccaacatggtgaaaccccatctctactaaaaatacaaaaattagccaggcgtagtagcatgtgcctgtaatcccagctactcgaactgctgaggcaggagaatcacttgaacccgggaggcggaggttgcagtgagccgagatcatgccactgcactccagcctgggcaacagagtgagacgctgtctca

SEQ ID NO: 20193 - DNA, 426 bp, Homo sapiens
tcactacaaaaataaaaataaatataagctgggcatggtggtaggtgcctatagttctagctgaggaggctgaaaaaaaaggatcccttgagcccagaatttcaaggatgtattaagctctgattgcattattgcactccagcctggcaacagagcaagaccctgtctcttaaaaaaaaaaaaaaaaaaaaaacaaaaaactgctatataaatggagtcacacaggctgttaccttttgaaattggccttttttcactcagcataatgcccttgagttccagcaaagctgttgaatgtattaccagtttgttcctttttattttgtactccatggtatgtatggatgtaccacaatttgttaaccattcatttactgagggtcatttaatattacaaaataaacctgctttaaacatttgcttgta

SEQ ID NO: 20194 - DNA, 395 bp, Homo sapiens
tgagcgcagtgatggagagagggccaggaaagttggagggaagtgtcccaggtagctgggcaaggccctcaggagtcctgcattggtaaatcctgctgtactccatcatttgctgggagcagcatgtgggagctgtggccttggcgcaaatgcagcagatggtttcagcggccagcagctgggcccttccttggtcagttagctccctgttattggagatctgtaaggtgcgtactcatggttgccttcctcccaccccacaatattgtactttatatattaaaagtgccctaggctgtgcgggcttgagacaggggccagtctccctgccctttgagttaccagtgcagactacctggaatcttcattgtttaagagggccctaagcttcctgt

SEQ ID NO: 20195 - DNA, 313 bp, Homo sapiens
ccaccgtgtctggctaattttaaaattttttgtagagacgggtccccctatgttgcctaggctattctcatactcctaggctcaagtgatccttcagccttggcctccttagaattgttcattttaacttggggatggcaacatgggtgcagtgagtgtttaaagataatatgagggattttgatgagtttaattcaaaacatggaaacattcagatatcttatgtacagggcattgtctatgttatacaaacatttcttccagagtaaaatctttgctcacatttactactatgtgaacaaaataaaaatgc

SEQ ID NO: 20196 - DNA, 880 bp, Homo sapiens
tttaaacaacaggaatttatttctcagagttctggaggctgagcagttcagaaatcaaggtgccagctgatttggttcttggtgaaagccctttttgtggtttgcagacagaagcctttttgctgtgtcctcacatggtagagagagacatcaactctctagtttttgtaatacgggcacactaatcccattcatgaggggtttcaccctcatgactcaattacttcccagaggcccaccctccaagcactatcacactggggattaaagattcagtctgtgaatttgaggtggacacaaatactcagttcatagcactgcaggtatagttttgaggaccctagctttatgtattagtctcaattccaacttcttaccttgcatagacccaaggcctcttctgctgccctccccttacaatacaagcctatagttggaaccttattctacaggcctttataaagactgccaggggtggtgcttctctgctgattaatactgtattttttaaaaataatcttttttctagcatcggagaagttctctttcacgcaataattctaaagagaaatgaaattcaaaaactgggagtatctaaactcaactgctggctaattcaaggtagtgcctggtggtgtggaacaatcattttgaaatttctgacatctaaaatcttaggcgtttcagaccatatttgcctgagtgatcttatagcagccggaatcttaaggtatacagattttgatactttaaaatacacctgttctcccgaatttgacttcatggaaaaaagcgactgtgggtgatatttcgcgtgtttaagctacaaaccgtttatctaagaaaacagctccttgaacacagtgagctggcttttcac

SEQ ID NO: 20197 - DNA, 951 bp, Homo sapiens
taatcatcaaatttgttataaaataatttctgtcactataaaataatttgaattaagagtttacttgccaaatattttcctttttctggccttctgaggatgctgtggaaaaataattgtctcaccaagagcaggttgtaaataatcagtagaaaaatagaagttctgcattgggtttggttgttggtatctacttttagccttggagatcaaatagctaagtcaaagatcaaagtggtgtgtataactgttgtaattcttatgaggatcaggtctcatatgcaatggtttgaatatatgtctgtaaaacatcaagaagtaccaaatattgtaatcagtctgcaaggctttgtgaaaatgacagtgcacagaaagcttatgacctacaatgtatgttgaaagaggttaagtaaaacagtttttcatgataaattgtcttattataaaatataattaactacatggtggtttcttctcagcagatattgattttagctcactctttatcatcttctctttattttttctgacttctttctacttttcatttttcatgatatttctctttattttcagttatcttgagaagtcagcacatcgtatatttggttcactgtagttttttgttttcttagtgggatgtctaaatacattggatttatctgttctataaactttgttattcttacatcaataaagtattactggctaaggctataatcatttgtgtaattttaattcattttactttattttctcccagatttgcctgagtgatcttatagcagccggaatcttaaggtatacagattttgatactttaaaatacacctgttctcccgaatttgacttcatggaaaaaagcgactgtgggtgatatttcgcgtgtttaagctacaaaccgtttatctaagaaaacagctccttgaacacagtgagctggcttttcac

SEQ ID NO: 20198 - DNA, 495 bp, Homo sapiens
tcgcttgagcccaagaggttgaggctgcagtgagctatgatcacaccactgcactccagcctgggcgacactgtctcaaaaaacaaaacaaaacaaaacaaaaaaaatggctggctatgaaatagacacagaatttatagaagagaattgagaaactgacctatatgaatttgatacataataaggtgataattcaaataacttgttcaaggatgatattttaaatttggttttggaaaggatgggggcagttagactgttttcagatactaaaataatttctgcaacatgaaaagaaagatttaaatgtaaaaacttctagaaaaataacatagtataaatgttttttaaaactctggttaagggaatttctctcttaggccaatgatatggttttgaatatgtgtcccctcaaaatctcatgctgaaatgtggtctccagtgttggagatgggaccgggtgggtgggggcaggtccctcatgaatggcttggg

SEQ ID NO: 20199 - DNA, 112 bp, Homo sapiens
ctgcgtcgactggtttccttgctggaaagtgtggatgataatttccatatctgtgtggcaagaagaaaatgaggtcatgtgcgtcatgatgcggcccagcacctggcatacg

SEQ ID NO: 20200 - DNA, 262 bp, Homo sapiens
agtttagggagtaattagattttgattagtcaaggatgcataatcttttgtaatattgtaatatataaggtaactaaaaaataaaaatatggggagatgatataaaaaattccagcaaaagataagaaaggaaaaggaacataaaacagttggaacaaatagattgttagtgttcatttatagatacagctcaaccacatactctttacaagagataaacctaaaatacaaggaaacagaagaaggtaaaggtaaaaagatg

SEQ ID NO: 20201 - DNA, 443 bp, Homo sapiens
ttcaaccctagacactgccgtggggtcagagccccgcagcctgcctgactgcatgctccacctagagttttgagccagcaggcactgaagaagcaatccacaccctcatcgcgtgccctgcgaggggaacaagggaacttttcctgtctcacttccagcaggggaagaacatacaaccattttgaaatacataacagcattctgttcatatcaaggcctccactcaagacaaactacttaattagagcctaactgacctggagaaagggaaatacccattacctgcccctctagcctttctcttggggtaaaggaactacccaactcagccccctctagccatcatatcccatataagtggaggatagagaagactgagaagcagttgcaaagttcgcagcccaggagcacaggctaagaattaatcgtaggtatacagaaca

SEQ ID NO: 20202 - DNA, 316 bp, Homo sapiens
ctcaccatttcttgccaccaatcattcctccccaaattacttctcctgccttctctatttctccaaaagcactaccgtcttacagattcaacgttgtaatgcaatgatgtgctttatgactatgaaaatggtacgcgagttctttgttttttttgtgtgtgaaattaagattaaaatggataagtagtttacaagtatctagtccacactcaattactgttaccttaggtcttttaataaatatatactgattcctgagttccttgagcaaagactctgaattattcaaattgtttttagcactttaagttttcag

SEQ ID NO: 20203 - DNA, 867 bp, Homo sapiens
tcagcagggtcagaacctataatttcattcggtatattctgtgaagatgtacagccagcaaaagctttttaattcgggaaaacacgattggacttgcactttcaaaagattaccgtggttgcacagaagagactgactgggtcagaggttagttacaggctggaaaaccagtttagatgaaactgaagagcaaggatgaaagcctgaactagagcagtggaaatgcgaatgtggagcagaggaacgattcaagaaattctgcggtaaaactcatcagacttcatgactgattaaaggtatggtggtagacaagggagggagaggaaggataagaatggagaagcaggaattgggcgttatttgaaaatttctgacatgggaggaaaatctggatatttaataacatctgactaaattaggggatgaaagagcataagcggagagggaatggtggtgctctctccttgaccatactttagttaggctcctctgagccctcttcccaactaggcctcatccttgggcccctgtcttaggcctgctgagtccagttttagcaagaatcttgcaaagtcagtttagagagtatctcctagccttgataattgatcatctccgcctgtcttcagcaagaatcttgtaagtcactttaacaagaatatccccgacccttgatatcacttcttagtaattttccatgaactgacccctcagtctgcttgctggttataaatcctagctgtttttgttgtattaaaacttgaggccaatctctctcccccatggtgatagtcatggcacctattgcaatagttctaaatgtcttccttgacattttaacaagtgtcagaataatttttctttagc

SEQ ID NO: 20204 - DNA, 3847 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20205 - DNA, 3458 bp, Homo sapiens
tcagcagggtcagaacctataatttcattcggtatattctgtgaagatgtacagccagcaaaagctttttaattcgggaaaacacgattggacttgcactttcaaaagattaccgtggttgcacagaagagactgactgggtcagaggttagttacaggctggaaaaccagtttagatgaaactgaagagcaaggatgaaagcctgaactagagcagtggaaatgcgaatgtggagcagaggaacgattcaagaaattctgcggtaaaactcatcagacttcatgactgattaaagattgtcttctcctccaaggtctacatgattacctgaagtttaataataatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20206 - DNA, 4005 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataattttgcctttctagagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20207 - DNA, 3720 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20208 - DNA, 3652 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20209 - DNA, 2151 bp, Homo sapiens
gcaattcagtgaaaaaactgggcaaaagatttaaacagacacttcattaaagaagatatacaaatgactaataagtacatgaaaaccttctcaacataattagtcattagggaaataaaaattaaaccacaagataccactacctctataatgcaaaacttaagacttgacatactaactttgggcaaagatgtagagcagtgagaactctaatatattagtggttggaatacaaaaatggaagacagtgtggcaggttttttttaaaataagcataccctttaccatatgaaccagcaattttattcctaggtttttgcccaagggaaatgcaatcatatgcacatgaagacttatgtgtaaatgtttataatcgggttatttctagtagctaaaaactgaagagagccagaccagaactgcagagaacaaattgtgttgtatctatacaatggaacaccatttagcaatgaaaagaaaggaactattgatatatgctacaacatggatgaatctcaaaagtattttgtccataaaagaaggtagatacttttgattctgtttgtatgaaattctaggaaagggaaagtgggcaccaactataaagaggcttaaaggaactttttacagtgatggaaatggctatgtcatgattattgttgtgcttacacaagtgtatacatttgtcaaaacttgtcaaactatacagttaaaattggtgagttgcactggatgtaaatgatatgtcaatgaagttgatcccaaaaaaaaggaaagttggaaagggcatttcagcagtggtgaacagtatgaccaaaagcacagagagaatagaagaagtatactaatttcacagaataatgtattttggaagatgaattttatcttatagttttacccattattatggattacttctactgtcagtttgaataatgaaattagtgaatctttgtaatgtgcctaaaaagaagttaattttaaataaagacaaattaacagttcattgctcactttatcccctcttttcttatccccttatccttttcttttttgctttaacagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20210 - DNA, 2956 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactgttagtattttggtgaatcatagtttagtaattgttttggggggtttgtgtgtgtgagatttgcatgtaaaagttgcaattgccttttttaaaaatatgagatacttgcatcctgttgtttttacttaacatattaaatgtgtctcaagtcattctaaaatattcaattatttttatttttatttgtttttcgacacacgctctcactcccgttgcccagggtagagtacagtggtgctatcttggctcactgcagcctcaacttcccaggctcaagtgatcctcccacgtcagccctcccaagtagctgggaccacacgtgtgcaccaccatgcccagctaattttttctgtttttagtagagagaagatttcaccatgttgctcaggctcctaacctcaagtgattggcctgcctcccaaagtatatattatcattatatcttcctctatttattaaacccttttcattttgattaccgaattaaa

SEQ ID NO: 20211 - DNA, 2970 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactgttagtattttggtgaatcatagtttagtaattgttttggggggtttgtgtgtgtgagatttgcatgtaaaagttgcaattgccttttttaaaaatatgagatacttgcatcctgttgtttttacttaacatattaaatgtgtctcaagtcatttcccgttgcccagggtagagtacagtggtgctatcttggctcactgcagcctcaacttcccaggctcaagtgatcctcccacgtcagccctcccaagtagctgggaccacacgtgtgcaccaccatgcccagctaattttttctgtttttagtagagagaagatttcaccatgttgctcaggctcctaacctcaagtgattggcctgcctcccaaagtatatattatcataaaatataagcataaaatcatccacaatcctgttattcagagctgtagactttaatatatctccttctagtttattagaccttatacattttgtatagctgatattagattgtagttg

SEQ ID NO: 20212 - DNA, 425 bp, Homo sapiens
tttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagtaagttgacttgtatgtcttatttttttaaattttacatgattaaaagaatcagcacttattaaatgtcattgatcttcagaaggatcaacctaggagactttcttctttgtgtcttcatatctcaaaagaagaacaatttaggatatttttatttgttgtttttcttaacaagcctctgacatgcaaacatattttaagaaagtttttgtgttttatatagtgtgattcgtagcccattatgataattttatgatggaaaagtgagagtatgtatg

SEQ ID NO: 20213 - DNA, 3928 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttga

SEQ ID NO: 20214 - DNA, 3766 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataataatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20215 - DNA, 3585 bp, Homo sapiens
tcagcagggtcagaacctataatttcattcggtatattctgtgaagatgtacagccagcaaaagctttttaattcgggaaaacacgattggacttgcactttcaaaagattaccgtggttgcacagaagagactgactgggtcagaggttagttacaggctggaaaaccagtttagatgaaactgaagagcaaggatgaaagcctgaactagagcagtggaaatgcgaatgtggagcagaggaacgattcaagaaattctgcggtaaaactcatcagacttcatgactgattaaagattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20216 - DNA, 2708 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataataaaaaagtcgacgcggccgcgaatttagtagtagta

SEQ ID NO: 20217 - DNA, 2969 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactgttagtattttggtgaatcatagtttagtaattgttttggggggtttgtgtgtgtgagatttgcatgtaaaagttgcaattgccttttttaaaaatatgagatacttgcatcctgttgtttttacttaacatattaaatgtgtctcaagtcattctaaaatattcaattatttttatttttatttgtttttcgacacacgctctcactcccgttgcccagggtagagtacagtggtgctatcttggctcactgcagcctcaacttcccaggctcaagtgatcctcccacgtcagccctcccaagtagctgggaccacacgtgtgcaccaccatgcccagctaattttttctgtttttagtagagccaaagtatatattatcataaaatataagcataaaatcatccacaatcctgttattcagagctgtagactttaatatatctccttctagtttattagaccttatacattttgtatagctgatattagattgtagttg

SEQ ID NO: 20218 - DNA, 1680 bp, Homo sapiens
gcggccgcgccgggcaccaccctccaagagactggtatcgcagcccccagctccaaggaactcagcgcaggcaggggcttcagggacgcggagagggaggcttatctctgctgaaagggaatagcggcccgcaaacaagcaaaccaggacactgctccgaggtcccgcccaggaaggcaaaacgaagtcccaccgctctcacacccggcaaccaaccaaggcacagcacgccccaccagcaagccacgcctcgcgcatcacgcacgcacgcacgcacgcacacacgtctgtcgcggcttcccgccttgcgctccgtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactgttagtattttggtgaatcatagtttagtaattgttttggggggtttgtgtgtgtgagatttgcatgtaaaagttgcaattgccttttttaaaaatatgagatacttgcatcctgttgtttttacttaacatattaaatgtgtctcaagtcattctaaaatattcaattatttttatttttatttgtttttcgacacacgctctcactcccgttgcccagggtagagtacagtggtgctatcttggctcactgcagcctcaacttcccaggctcaagtgatcctcccacgtcagccctcccaagtagctgggaccacacgtgtgcaccaccatgcccagctaattttttctgtttttagtagagccaaagtatatattatcataaaatataagcataaaatcatccacaatcctgttattcagagctgtagactttaatatatctccttctagtttattagaccttatacattttgtatagctgatattagattgtagttg

SEQ ID NO: 20219 - DNA, 4398 bp, Homo sapiens
ggagtccggggcctcctggcgtcactcttcgccttcaactctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggaggtgagaagctgacccctggggtaggtgggaggacacaggggatgggcagtctccgaggctctgtctcttctctctcccacccctgggcagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgtgagtggggaatggggtgcatgagtgtgggttggccctggtgccccagcatcaaaaagtactctgggtgggataggaggagttccaatccaagaaagagccagggagaagtcaggttattcattctctgcacccctagcaggggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcaggaaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcatttggttgtggatgagaagtaaatgaagtgctgagtgttaactgttgcctcagaagaaactgggagggggaagtcttagaagtgtttcaacataataaaagctctctcattctgaaatgtgggcaaatttcagggattgatagatcctagcaaactgtgtccctggttcccgtgcttgagatcttatacaggacttgaaccaggtaagctgctacaggatattgggcagaatgcaggaccaggaagcaagaaaactgagtctgccacagacaaaccaagtgatcttgagcaggcaacttctcctttggggacctcagtttcctcatatctaaaataagggtgacctggataaacattcaggtcacttccagccttgacattctatgactacctatatctcagggtgtttagggcacatgcctttgggtagatagcatgtggaaattgttactattccccatgctcctgtccacactactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcgtccagttccacccatgttgctggaaaacacatgatttcattcttttttatggctgagtagtattccactgtgtgtgtgtgtgttgggcgatgataatgatgtccattgctgtgtgacagcttggaatttaatttattaaagtcaagttggagtttaaaaact

SEQ ID NO: 20220 - DNA, 4302 bp, Homo sapiens
ggagtccggggcctcctggcgtcactcttcgccttcaactctttccgggagaactggcagcgggcttgggtgcgagcgctgaacgagcaggcctgcagaaacggggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggaggtgagaagctgacccctggggtaggtgggaggacacaggggatgggcagtctccgaggctctgtctcttctctctcccacccctgggcagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgtgagtggggaatggggtgcatgagtgtgggttggccctggtgccccagcatcaaaaagtactctgggtgggataggaggagttccaatccaagaaagagccagggagaagtcaggttattcattctctgcacccctagcaggggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcaggaaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcatttggttgtggatgagaagtaaatgaagtgctgagtgttaactgttgcctcagaagaaactgggagggggaagtcttagaagtgtttcaacataataaaagctctctcattctgaaatgtgggcaaatttcagggattgatagatcctagcaaactgtgtccctggttcccgtgcttgagatcttatacaggacttgaaccaggtaagctgctacaggatattgggcagaatgcaggaccaggaagcaagaaaactgagtctgccacagacaaaccaagtgatcttgagcaggcaacttctcctttggggacctcagtttcctcatatctaaaataagggtgacctggataaacattcaggtcacttccagccttgacattctatgactacctatatctcagggtgtttagggcacatgcctttgggtagatagcatgtggaaattgttactattccccatgctcctgtccacactactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcgtccagttccacccatgttgctggaaaacacatgatttcattcttttttatggctgagtagtattccactgtgtgtgtgtgtgttgggcgatgataatgatgtccattgctgtgtgacagcttggaatttaatttattaaagtcaagttggagtttaaaaact

SEQ ID NO: 20221 - DNA, 2733 bp, Homo sapiens
ggagtccggggcctcctggcgtcactcttcgccttcaactctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagttta

SEQ ID NO: 20222 - DNA, 2103 bp, Homo sapiens
aaggctaggtacgaggctgggtgaatcggccgcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagttta

SEQ ID NO: 20223 - DNA, 1930 bp, Homo sapiens
ggcccagctcacagtgccatccctttccccagccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagttta

SEQ ID NO: 20224 - DNA, 1771 bp, Homo sapiens
aaggctaggtacgaggctgggtgaatcggccctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagttta

SEQ ID NO: 20225 - DNA, 1640 bp, Homo sapiens
  misc_feature (1503)..(1503): n is a, c, g, or t
ggagtccggggcctcctggcgtcactcttcgccttcaactctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacacagcatgttcaggncgtaatgcctttgtcaaaggccgacgaaaaaacgtgatttgagcctggtattgcaaacggcggcggaccctaagaagggtcaggcgatcggagaagggaccaaaaagggaacgcacaagacgcccgttctgcgggga

SEQ ID NO: 20226 - DNA, 1616 bp, Homo sapiens
ggagtccggggcctcctggcgtcactcttcgccttcaactctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaatccagcagcccaggaggtcgacgcggccgcgaatttagtagtagtaggcggccgc

SEQ ID NO: 20227 - DNA, 1668 bp, Homo sapiens
gaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactata

SEQ ID NO: 20228 - DNA, 2505 bp, Homo sapiens
gaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatccatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 20229 - DNA, 2450 bp, Homo sapiens
gaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaata

SEQ ID NO: 20230 - DNA, 2196 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20231 - DNA, 1928 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttcttgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20232 - DNA, 2319 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaacagattaatactccctttttatcattacagttagctaaaaaattgccaggcagtccacaaaacagaatttgctttaagaccaacccacagagtcagctggagactaacggcgctggggcctgctgggccgggatatagtcgtgtttagctaagtgtcgagagcattaagaagaaagtcctggttggaggcgcaaggcctgcagcaccagctgtggaatccccaataatgt

SEQ ID NO: 20233 - DNA, 2142 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgatcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20234 - DNA, 1464 bp, Homo sapiens
cattctgttgagacgctctggcgccgagaaatgttgttgaacgactggtgatgagtcttggtgtcctgcggagatgccatggctcgttgcctttgggtctgtgattcctggccaattggagctagcgacgcctgcgtcgccgggccgcagcgtactgacccatgtgccggaatgccgccttctgtcgtcgtcgctgtcttcttctcttcgggatctcccagcgtttctctatcatccgtgggtaatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20235 - DNA, 2049 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20236 - DNA, 2075 bp, Homo sapiens
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactgg

SEQ ID NO: 20237 - DNA, 190 bp, Homo sapiens
tcctggcagagaaaggcacactcctcccagcagggagtcaggcccccgaacttgccagccattgggccacgcctagccttgactgggtgctctcggctcagcccttcacaagggctcttcccagagacagatctcaagggcctcagatgccaccaagtgcaaactgttcgttttgccctgaggatatggg

SEQ ID NO: 20238 - DNA, 401 bp, Homo sapiens
  misc_feature (401)..(401): n is a, c, g, or t
gcccagcccaaaatttactacctcttaaaaacagttttttcccatgattaaagcatgtggaaaaactgatctaactccttaacttcatcttacttttgctgagacacttaaaaatttatagtactggcaagaagttccacttcccccaattcgctgtacatgtaaacttgatttagacacctggtgatttgtagtaaacagtcttacataaaccgttggtttgttgacttaggaatatatctaatcaaggatgtgaaagacctctacaaggaaaactacgaaacactgctgaaggaagtcatagatgccacaaccattagagccacaccccatgctcatggatggggagatcaatattgtgacagtgccaccttcaaaggctctctccagtgtagtgcatn

SEQ ID NO: 20239 - DNA, 2298 bp, Homo sapiens
  misc_feature (752)..(752): n is a, c, g, or t
  misc_feature (1292)..(1292): n is a, c, g, or t
  misc_feature (1478)..(1478): n is a, c, g, or t
tatgtacttagaatttgagttctgataattcatttttttatgggaggtggggaggtttattttttaaattgcagtccaaaggagtaaatttgatgttacattggacagtttattcagataccacaaactttacagatttaattagatagataatggatgatgttaaaaactaagcagcatcttaagtttaaatttttatttttatttctttttctgtcatcattatttatgaaaactggttgaaaatgaagttaaaagattttctgtacatcataagattggacagaaatattatttaccttaaaactttttctgagtaaaaatttaaacataaactagaactcagcctgaatttttttttaaaccatctttggaagcacatataaaagtagagtaaatacatcgaatgtagcttacctactgcatttgaagaaaatcttttgtgtatgtctgtaagctatttgtgtgttttgaaacagtttaccagaatagactgaaactggtagaaacaggcataagtaactctgcagtggtagttgtattgaaaactggaatggtagtctctttcaaaatcttgaagagatggaaactaatgaatctttttttttttttggtaaaatagtatttttttttgttcacttaaatgaaattatttgtactttaagttttgttccaggaaattacttcagttgtagctaatttattggcaccctttactaacaaatttctgttctgtattaagattagtattngaaaaaaaaggagatgtatggaaattaagaaagcaacaaaaattataagaataattgcccttataaagaagtcattatatgaaaaagatacttgcacacgcatgtttatagcggcacaattcgcaatggcaaaaatgtggaaccaacccaaatacccatcaatcaacgagttaataaagaaactgtggcatatgtatacgatggaatattactcagccataaaaaggaatgaattaatggcattcgcagtgacctggatgagattggagactgttattctaagtgaagtaactcgggaatggaaaaccaaacatcctatgttctcactcataagtgggagctaaaccacgagtatgtaaaggcataagaatgacacaatggactttggggattcaaggggagagggtgggtagagggtgagggataaaagatgttgggtgcaatgtatactgctcaggtgatgagtacatcaaaatctcacacatcaccactaaagaacttactcgtaaccaaagaccatctgttccccaataacctatngagataaaaaaaattcaaaaaaagaaaattgtccttatatacatgtcagacaaaagatttaattatatttggtaagaacattgtagattgttttgtagtgtattctgagaacttatgtcagaggccagaaatggccattgttaccagaagtaatggaaggaaaggaaaagtaagggtatgcttacnattttaggtaatctgatttctgcatattgtagtgtaaaaatatgatagttctattcaaaattttggagaaacatttgaacttcgtttattttaaattaggaaatcagctcaaataggcattggcctttgatttaagagtgttaagtcattcttatgtagaaatgtgctatctcccgagaaagcatcagtgtgggatgccttcagctcatgccatcccctcttccattaggaagcatttgtaaatgcttagccgtgttagggatcatgttagatattgggggcagtgactctgaagagattgtgcgacataatctcaaagagcttagggtctggtagggagacaaccaagcaaacagctactctaaaatagagacatgcttatggcttgagtgagtacataagaggggcacctgacccagactgggagggaaggaggcacttgtgagatgcttatgcttgaactgactcctgaagaacaaataagaattagattaataaagatgagagagaaggctgggtgaggtggctcctgcctgtattcccagcaccctgggaggctgaggtgggtagatcacctgaggtcagcagctcaagaccagcccggccaacatggtgaaaccttctttctactaaaagtacgaaaattagctgggcttggtggtgcatgcctgtaatcctagccactagggaggctgaggcaggagaatcgcttgaacctgggaacctgggaggcggaggttgcagtgagccgagattgtgccactgcactccagcctggacaacagacaacaaagcaagagtccatctcaaaaaaaaaaaa

SEQ ID NO: 20240 - DNA, 397 bp, Homo sapiens
cagtagatttttcaggtttgcccctggccttgtcactttacacattagcagctactgcttccatgtggctctgctaatactccccccttaaaaagattaatatgctacatgcttatatagagacagtatagtataggaattaatagcatgggctctggaataagaatgcctgaattcagaaactagatttactgcatattagctgtgcttttctcatcagtaaaatggatatactagtactttgggattgtcatgaggttgtcatcatcattaaaatttcagtaataggctgggcgtggtggttcatgcctataatcccagcgctttgggaggccaaagcaggaggattgcttacatacaggagttcaagtatgtgagaccgtgtttgtataaaaaa

SEQ ID NO: 20241 - DNA, 340 bp, Homo sapiens
tgcactcttaactgggtgacagagtgagatcctgtctcgaaaaaacaaaaacaacaaaccaaaaaaaaaggtgacattgagaataaagagatggtggttggatttgtggctatttttccagctgctcaatagttgtacaaaatgtagcttgatatgatgagtgtttccaaaattcctaaattacatgtcatgtttgttgattatttgtatatgttttaatgtgtattaaaaagacaccaaaggtgtgagttcataaattaatacttaggataaacttaagatttggaaggaatttaaagttgaagagagttgaagtaggtgatagtttaggtggtctttg

SEQ ID NO: 20242 - DNA, 247 bp, Homo sapiens
atagcagcccaaaactagaaacaacccaaatgcccatcaatgcatgaatggataaactgtggtatatttatacagtgaaatactattagcaataaaaaggagcaaattactaatatatgaaacactatgaatgaatttccataacaagccagataacagaagccagaaataaggcatgaagctaggcatggtggctcatgcctgtaattctagcattttgggagtccaaggtgggtgaatcacttga

SEQ ID NO: 20243 - DNA, 449 bp, Homo sapiens
ggtccaaacatgaaaacatcctccccttgtgaaatctctgccttctgttatgtgcctgaggatgatcagaggcagcacttccactgccactttgtcagagaacatttctcagggaaggtctgccagggctttctgccagatgcctcctgctctgactgaggtggctcaagaagccatctcaagctaaagacctgcccacagggaagttaatatgacgttttcaactcctatttgatttctactctatttctgtgaggtccttttcaaacctatgtgggttcattaaatgctcccatagacctacgtgaggaggaaaaaactagtaagccaaacaggccacgtcattctttcttccatagctgccatatcaaagggctggtggatgtggtcatagttgccatttcccaggagctgatatcacagaggaaaagaattttatttaaggcaaa

SEQ ID NO: 20244 - DNA, 316 bp, Homo sapiens
ccagccacttgaatgttatgggaaagcccaggagcaggtggaagattctgccctggacactgaagggtcccactgcggaggcactatcccatcgtcccagggaaacttgtctagacgctacttcacctccgtcccctaaggggggatgtgacccccctcttacctctgggcatgaccttcagcacattgctaccttccctctctgccctcaattttcctaagggaggtgagctccaggatctctgcagggcttttgaactcagtgttttctgctagctttgagcactttggaaggatgatgttagagaacttgtga

SEQ ID NO: 20245 - DNA, 757 bp, Homo sapiens
gagaattgatccaatgactgctggtgtgtagaatgaattgcgatgaaacatctcatcctacctgctcctcattcccttttctgccaacgatttatcttcagaagacaagcagatgaggagacaaaacctactgatgtgggtacccaagcaggaacccccctcttgcaccggcgactcacgtgggaagaagaattcactgagctgaaatggagtgagagctaagatgctctcagaatattcttaaaatgactgtgctgcaaagaagcccgggtgaatagaagaaaatagaaggaatggtggatacaagtgaaggttaaaatgagaccccatttatcgcaccagctgttggtgatttcagcgcacctttccaagcctcttgagagttctgctctaaccacactgccccctagtgttctctcgctttggtgcaactgcaggtttctcatacttccggagaaatagaaagcaccagatgacagccaccacacacttttgtccccattgcaataggatgcttctaacaatcgtaaaattatgaaacactgaattccttaaaagttgtccatttgtggatttatctgatggtaactattaaatatttaaaagtaactttaatgaatctacttatgatgattgagtaatctattctctgaattccaccaaaaaaccattttatgaccacagtcataacgaacatatttctatagtcctaagctggcaagataaatagagaacagttcataatataaacaatata

SEQ ID NO: 20246 - DNA, 402 bp, Homo sapiens
ttccagtccgcgtctgaaggtgcaagaatcagagcatggatgtctgaagcagggaaaatatggtgtcccacctcaaagaagagcaaatttgcccttcctctgcctttttattctattcaggtccttaacagattaaattatgcctgcccatagcggtgagggcggtcttctttactcagtctactgattcaaatactaatctcttccagaaacagcctcacaaatacacctagaaataacattttaccagctatttgagcatcccttagcccagtcaagttgacacttaaaattaaccatcacggtggctcaagcctgtaatcccagcactttgggaggccgaggcgggcggatcacttgaggccgggagttccagacctgcctgaccaacatggtgaaacc

SEQ ID NO: 20247 - DNA, 426 bp, Homo sapiens
aaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcc

SEQ ID NO: 20248 - DNA, 535 bp, Homo sapiens
ctgtcatgatagaaagaaattttttgcatgtaggtaaaattctgtgacagatgtaagagattttaaaatatctatactatgagtttgcgtgtgtgtgtgtgttggagtctcactctgtcacccaggttggagtacagtggcacgatctcggctcgctgcaacctccgcctcccgggttcaagcggttctcctgcctcggcatcccgagtagctgggactgcaggcaactgccaccacgcccggctaattttttgtatttttggtagagatagggtttcaccgcgttggccgggatggtcttgatctactgaccttgtgatccgcctgcctcagcctcccaaagtgctgagattataggcgtgagccaccactcccggctgagtttgatatttttttaagctgcaatttgacagcattttatcatacatttggaaatcctttgaggcaaaacacccaaagtattaattggacagcatcttttatgtcacacagttcacctaaagctaaagaaaaatacttaatatttttcaaattt

SEQ ID NO: 20249 - DNA, 258 bp, Homo sapiens
ggatgaggtgggagggttgcttgaacccaggagcttgaggctgcagtgagctgtgatcactgcattgcagcatgggggacagggagaccctgtctcacaattttttttttttactaaattccagactacagtttttggattacagatgtaattcagcaatgaaaaagtttagaactttgtaaacattatttcagttttagaaatctaatgttacagagaaagacttgtgtctcaaatgaagagttttatcaggctttg

SEQ ID NO: 20250 - DNA, 353 bp, Homo sapiens
tacaaagaggtatgagaaatccctcctattgataagaggtataagaataaaattaaaaaagaaatccctgacctctagagagttcacatgttgagaggggtgtgcagtttgtatttgcagagcaggttaaatagtcttttatgaatggataataaattcttgatgctctgtaatgctacactctcacaaatgatcgaaaaatttagatttgaatttaaaatgtattttggggtcgggcgcagtagctcacacctgtaatcccagcactttggtaggctgaggcgggtggatcacgtgaggtcaggagttcgagactggcctggccaacatggcaaaaaccccgtctctactaa

SEQ ID NO: 20251 - DNA, 451 bp, Homo sapiens
aaaaatgcccaaaaccatggcagaactaactggcatgctgttcccatcaagctccaaatatcaggagctcgacttttcttcatttgctcctgctcccaggatcagtgtcaattctgtgtctggaacttgatcttgtagccagaagagtagtagctgtctgcagagcttgtatcctcacattccttacatttccatgggtacatctagtaagtagagccaatgtcacaggcctgcattctaaccgcaagagaggcaggaaatttgagttcgcaattctatcctgggtaggtaggacctataatcagaaaagtatcccaaatatagaaaggttatttaaaagattatggcaaccatgactataacacaatccattactgatacacatgttaaacatttaaaggtattcaccaaaataaaagaactagtatgtggaacttccaaacctatagag

SEQ ID NO: 20252 - DNA, 417 bp, Homo sapiens
atcacaaagggagacggcgcagtggcccttgcttccttccgtcttggagttgttccagcctccttcccctgctgttggcttatgtgaagttgatacacatgtatcattcattcatccgttcatctagtagacatttattaagtaccgctgattagacaccttgctaacccatagatctaaatgttaaagatatactcctgatggctctcagatctcatgaacctggaaacaaataatatttcaggaactaaagctgtagggatacgttcttagccgtaattgtgaagataacccttccgcaagtggagggctctccagccgcatacaacactgccatcttgtgggaagtgctccgtagagccacttcaggaagccttgaccaaagctgcggtaaaaataattgaatctgtactttta

SEQ ID NO: 20253 - DNA, 280 bp, Homo sapiens
tctctactaaaaatacaaaaatttgccaggtgtggtggtgtgcatctgtaatcccaggctgaggcaggagaattgcttgaactcaggaggtggaggttgcagtgaaccgagagtggaatgatggtttgagctcaggagttcaagataagcctgggcaagatggcaagaccctatcttttcaaaaacagaatttttaattagccaggtatgatagcgaacacttgtaaagacatagaggatgcagtgagttgtgattgcagtactgcataccaccctgagc

SEQ ID NO: 20254 - DNA, 340 bp, Homo sapiens
tttttttgagatggaggctcactctgtcgcccaggctggagtggagtggtgcgatctcggctcactgcaagctccgtctcccaggttcatgccattctcctgcctcagcctcccgagtagctgggactacaggcgcccaccaccacgcccggctagttttttgtatttttagtagagatggggtttcaccgtgttagccaggatggtcttgatctcctgacctcgtgatccacctgcctcggcctcccaaagtgctgggattacaggtgtgagccactgtgcccagcccagagcttctgtatttatattgctggttgtaggcctcagaaaagcctttggg

SEQ ID NO: 20255 - DNA, 587 bp, Homo sapiens
tccaagactgctagtggatgcctgaaaccatgaataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacgcaccctttcttagatattggtggataaaagaaaaaaaagaaaagggagacttaaaagacttaaaattcagtgaggatagaggtagagggttgttcctagataccagtggtacagcaggcctagaaatcagcca

SEQ ID NO: 20256 - DNA, 1993 bp, Homo sapiens
gctgggcctggagaggcgcgtccctggcccatcttatcagcgctctgcagggtctgggcctgctgctcgcgtcctcctgggctcccaaggccacgggtgggttaatggcttgacagccggcctcctggcccagcagacgctgagcagcccgatggcacaatccacctcttctctccaaggccagctggagggacgaggcacgacaaggccatccctacagctggcacttcccctacagctgagagggggcctaaactacaggacacactcccaagacccttaagccctggcagcatcccgggggaggggggcagcaggtggaagtggaaagaagcctgtggagctgccagcagggagagggagtcggacatgaggctgagaggcctctgggaacccctgtgccaaggggctgctggcactgggcagcagcaccccagagcccacgaggagtgtgcccagagcaagtggctcagacctgggtcatggctcgagggtgtcgggctgtagctgctggtcccagagagtgcagcccagggcaggcatcaggacaggagtaggaggagaaagagtgttctaggaagagtctagtcccctaatcctggtggtggctggctgtagcctagtgcacgctgtctggcttgtgtggctgtgctgcctgagtatacataccctagcaacattctccttgctcagcactggacatcagctctccacctggccccttcctctagggaggggatggggaggcctcctagggttagcagcaggagttgggcctcaggaatcaggagcccttgaaaggaggatgcgtggttcccataaaactgagggttgccctgggccctacccttcctgagtcagctcttgcttcaattccttgaagcaccccagcatcctttcaataaatgcctgccctttgtggcctgcaaccagaggaactgcaactagcacactcactgaaggaatcctgctgctgctgctgctgctaaaaacaaccgaggtcatggatgagggggtggaggatactctcatcccacctccagactgacaacaaaaagacctaaagatctctgtgtacctgggactgtctaccattgaagattagccatggtaacttgttgacttagtgatcaacttcctgcagaagcccataggtccacctggactctgcccaggccagcgtgttctgaaaatggagggctctgtcaccattcactcaacaaatgtttattctgcactgaccgagggccagatgtaccaagagctgtggacacagcactccaacttactccagggctactgaaatcagggatggcttccccaaaaggcacactaaggaaagtctatgtcactagcagagaagaggcaccaaagacaaaaaatcaaaaaagaaaaaataccagaaacagtttgacatttgattttttttaagtagtcctcgtgggaaaaatcagaactttgttgtacttccttacattcatttcctgattacatgatgcttttgttttgaatcacgtgtggagggtgtcaccaaaatctttagatgctttgtccttatgtggatctggacccagatcctagcaaatgttaccatctctgcctcacaaagatctgacagaatgcaggcagttggggctatccttaggagagacagctctccttcgcagtagatgcacctgggtgataaatccaactctgaccacaaggtggcaaaagagtaaatgacaattcctcatatatgttttgtatgtttatataaaactattggtttatataaaatgctctctaaaaatattaagaaaaacgtgtgctccttcacacatttttgggttgatgtctgatattttgcatcacaaatgtcaattggctacaaataatgtaatttgtgacaaatgttaatattcaaaaataaaactgttatgtcactatttcacatgaatccggtgaaacctaaataccttagtgacttgagagccaccatcatctgttttaa

SEQ ID NO: 20257 - DNA, 372 bp, Homo sapiens
caaatggagtgatttctgcatccctggttgaacaacatgagaccactggtgtcacgggtgacccagttcagaggacgatgatgagcacttccatgtgcatggtccttcacgttacaaaacgctttcctatgcatgttgccctttgatcctccagtcagctggatgaagtatcctccttcttctccagatgaagagactgaggcctggtcattacacaccatgttcagggtcacttgtgaaattggaactcctggctgggcacagtggctcatgtctgtaatcccaaaactttgggaggctgaatggacagatcatctgaggtcaggcattcaagaggagcctggccaacatggcgaaaacccatctctacta

SEQ ID NO: 20258 - DNA, 356 bp, Homo sapiens
gccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaa

SEQ ID NO: 20259 - DNA, 282 bp, Homo sapiens
tgagaggttcgcagggtcagacgctgaactatgtgctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcaatgactgattggcattttgcaaatcttgaatttgatagtgccacacctctcgcgaaaccttgcgacg

SEQ ID NO: 20260 - DNA, 2078 bp, Homo sapiens
agcagggccaaaagagtgattgagctctgactggcgacccgacccggcggaaaccacctcgacagcctccagaaaggggcgtggctgaaaatgtaggggcgtggccacgtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagttggtgtccgtggcgggctggccgagggggcttcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcct

SEQ ID NO: 20261 - DNA, 1999 bp, Homo sapiens
agcagggccaaaagagtgattgagctctgactggcgacccgacccggcggaaaccacctcgacagcctccagaaaggggcgtggctgaaaatgtaggggcgtggccacgtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggttcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcct

SEQ ID NO: 20262 - DNA, 2352 bp, Homo sapiens
agcagggccaaaagagtgattgagctctgactggcgacccgacccggcggaaaccacctcgacagcctccagaaaggggcgtggctgaaaatgtaggggcgtggccacgtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagttggtgtccgtggcgggctggccgagggggcttcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcctcctcgtgccgaattcggcacgaggcccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccg

SEQ ID NO: 20263 - DNA, 2186 bp, Homo sapiens
agcagggccaaaagagtgattgagctctgactggcgacccgacccggcggaaaccacctcgacagcctccagaaaggggcgtggctgaaaatgtaggggcgtggccacgtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtaagtaaccctacttgcctttgggaactcacagctctcagcctcaccacgcccccgcccccgccccggctttgggcgacgccctcacgatccgttccctttttttaggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagttggtgtccgtggcgggctggccgagggggcttcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcct

SEQ ID NO: 20264 - DNA, 1437 bp, Homo sapiens
agcagggccaaaagagtgattgagctctgactggcgacccgacccggcggaaaccacctcgacagcctccagaaaggggcgtggctgaaaatgtaggggcgtggccacgtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcct

SEQ ID NO: 20265 - DNA, 438 bp, Homo sapiens
atgggtgcctgtagtcccagctactcgggaggctgaggcaggagactggcgtgaacctgggtggcagagcttgcagtgagccaagatcacgccactgcactccagcctgggcgacagagcaagactccgtctcaaaaaaaaaaaaagaaggaaggaaggaagaaagaaagaaagaaagaaagaaagaaagaaagaaagaaagaaagaaagaaagaaagaaagaaagaaaaagaaagaaagaaggaagtgactatgaacatctttaaatgtgtatctttaccttaagagttcactgtctccttagggccaattatttttatttattattttttctgagaccctgtctccaaaaaaagaaaagaaaagaaaagaaaggaaaagaaaggaagaaaggaaggaagaaagaaagaaagaaagaaagaaagaaagaaagaaaga

SEQ ID NO: 20266 - DNA, 358 bp, Homo sapiens
tcctgagaaaggtgttaatacctcttaacaaccctatcacctcctaaagacaccaccttccaacaccaccacattggagatgaagccacagcatgagctttggtggggacaaaccatattcaaaccatagcaattacctactgggaaaaaaagacttattccttcagatacacttacgaggtgaacaaattattcctacagactaactggttagttttccagtaacccagttgggcaaaatattttgtgacaggccaggcgtggtggctcatgcctgtagtcccagcactttgggaggctgaggtgggaggatgacttgagcctaggagttcaaaaccagcctaggcaacatggtggg

SEQ ID NO: 20267 - DNA, 139 bp, Homo sapiens
tctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaac

SEQ ID NO: 20268 - DNA, 377 bp, Homo sapiens
ttcatttgtggaaaatatttatgaataaatagttttatatgacggctggcacagcggcctctcctgtaccccctcaggagtcagtgagtaaggtgagggtcctgctggcgggggcccgggccagctgggggttgaattgggagttgtaccgccgccgccggtcatccgtctcgtcttcttccggctgaccctcctgtagtgcccggccttggacccgggccagcagggctgctgccgaggacctctcagctgcttccctccgcagacgttcagctcgaagctggtccagggatggagactccttgggtcgctgcttctcagacccctccttttcctttctgctgcgactgccttcatcaccgccgtgctgtctcttc

SEQ ID NO: 20269 - DNA, 629 bp, Homo sapiens
cccaggtgcccaccaagggccgcccagcaggcaggcctttctaggacagcagccctctcagctgtgccacataagctgtgggcaccacacgcttccttatcgtgcaggcagcaataagtaaataagatgaaccccactccccacagtcccgctgtcgctacaaattaaatgtttctttctttttggcatctaattctgttcatatttaaacacagtgagtagggttgaaatcagtattatatagacagttttggattcttttaaaaaatacgtattatttaaaataataaaccccattatatgctgatacattgcatatttatgaaaagtaacttttctaaagccaaataaatagaagagtggcattgacataagagggctggcatctcagccgctcgggccctccgtccattacaaccacacagcccagggccttgggaaggttctgccgcacacttgggagaggcgatgaggccttagcctttcgaggtcgagggcttgaccctgagattcctgggaaggcctcaggatgcctgggccgcatgtggagaactgtgagggcagacccaggtgcactcccattcccaggcgtgtggagggtttgtttttaaaagttaccaaaacacttg

SEQ ID NO: 20270 - DNA, 217 bp, Homo sapiens
actctgtgtcccaacccaaatctcatctcaaattgtaatccccacatgtcgagggaccgagctggtgggaagtgattggatcaggggggtggtctcccctgtgctgttctcgtgataataagggagttctcacgaaatctgatggtctaaaagtgacagtttcccctgcactctctctctctcctgctgccttgtggagaaggtacttgctttctcg

SEQ ID NO: 20271 - DNA, 315 bp, Homo sapiens
gggaatacagcagtgaataaaacaagtccttctgcttacattctagtgtttgagagtacagtgttacggaaacttttaaaaaaaaaaaactcaaaaaagagattagtcaacagtaaaacgcttagaggtgtaagatgaagttaggccgagtgaggtggctcatgcctgtaatccccgcacttttggaggctgaggtgggaggattgcttgagcccaggaattcaaggctgccttgagccatgattgtgccactgcgcagcacttcagcccaggagacagagcaagaccctgactcaaaaaaaaaaaaaaaaacag

SEQ ID NO: 20272 - DNA, 435 bp, Homo sapiens
gcccaagttccagggtaattaatcaactctaaaatggatgcaacaagtattggcactggatgcagacttgaaattaattatttaaaaggtggacctgattgtttttttaaggcagaaagacagaaattaaagaattttcttctttcatgaaatgcacgtggctggctgcaaggattagagcagatgctatgtttcagtgataacctaatacctgactgtgctcagacatctacgttgggaaagggagttgtaataagagttgggagtttgaggttatcagtgacccagaaacaaggtgatgtgaaaaaagaagagttgtgctagactgaagaaaaaaaattagatgatctataaaatgactgtgagtggagaagccctttgtcctagtccagctactaacagcataagcaatcagcacaggtgttgttgtcgttg

SEQ ID NO: 20273 - DNA, 316 bp, Homo sapiens
tttttttttaaaaaaaaaaaggtagtctctttttttttcaaatgtttttcccccatccatccagaaaatgaatttcccagaaaacaagaaatacattttctttgttgattgatttagttggttaggtgtggtcactggtgctgtcacaataatctctgtggttaaatgttaatcccacaagtcaaagccagataggcaaggaataaagtagcaatatgttaaggttcctgcaggaagagttttctatgcatcctactggtaaaagtgtgagagctccagatgataagataaaagggatatagaatatatgaaaagt

SEQ ID NO: 20274 - DNA, 414 bp, Homo sapiens
aatgagcaggaggggtgagattagttgcttccctgtactcacccatctccatcaggagctccgtgggcacgaatgcagaggaaggacatgcgatactgactgctgcctgctgataagtttttagttcttgattccaatagcagatggaaagttacaatgaaaccagttgtagtcagggaatttttctcttctcttccataaactaaaatgtcccattcaccagacaccttcttccatccgctccccaaagctccaatgtacaatggaacatacctcagacctagggataccaatcatgggattcccctgctatggctttgtttaaaaaaacgtttagaggatttttaaaaacagaatttaacacatgcttattatattaaaaactcaagcaataatgaaagccacaaatcacct

SEQ ID NO: 20275 - DNA, 1503 bp, Homo sapiens
agacactgagttttaagtctcaagtggatgaaggcagagatcgtgatacacttgagttaaagcagtagggttctgtcattttctattcctgttgtaaacattttctttaatgttattatttttaccactaaactaacgtggcctggtcacgactttcattggtaaagtgtgctgttcctcaccctccaccgttgctcctttggtccactgatcataagagcatttacctgaaggtcgtcagacctcgaatgccaacaggtcaactgcagtggcctgcagttaccacccagtctgttccaatgaacagaatcgctgttgccccaactcatctcccttcacctaggctgtaaattgaaagtcccacccctgagcggaacacaggccatcttgtgtgctgtgcaccaccagggggtggggaagtttccagactgacttcctggctccagtcatcctaggaaaagagttctccagtcgctccccacccccaccccttcccattccaggagtctattaaggaggcaaagcaggcctaacgggtatcaaagcaaaggagtgaatggagactgggagagtcttcaacctctcctctccttggtaggagctgaggctgcatgccaggtaccttcccttcgaggaatctaataaagctaggtcactggtgttttcaggtgcttctcaaaggattgccgtaggggtaggatatcaggatgtgggagcacaggtgccaccacagcactagtgatggagagtcattgcccctagacttctgggacagtgagactgtgaggaaagctgaaatgatactgggaaagggtgaaagaaaggatgtaggtggaatttatttagtattaatgtaggtacacataccttatggcaacattcctagcactctaaattctagatttgtatagtttctgtcaatatcttttgtaagcttaatcaatacagggcatgacaagtatgtgtcacatacttttttttccacgaagaaaaaaaataagtaggaattgggtgctttgtttatcaaaatttgtatttcctttataaataaactttgaaataaaggttgaaaattagtatcttttctagccgagccaccattgtttttaaaaatcctctttgaagcaggtgtgtgtgtgtgtgtgtgtgtgtgtgtgtgtgtgtgtgtgacgtttttcaacaaaatttttaaaaatcgaaatgtcagggtcaggtgcagtggctcatgcctctaattccagcactttgggaggccgatgtgggaggattgcctgagctcaggagttaaagaccaccctgggcaacatggtgagacctgatttctactaaaaattaaaaagattagctaagaatggtggtgtgtggttgtagtcccagctactcaggaggctgagaaagaaggatcacttcagcctggaagattgaggctgcaatgagtcatgatcacaccactgaactccagcctcagcaacagggtgagaccatgtttcaaaaaaaagaaaa

SEQ ID NO: 20276 - DNA, 476 bp, Homo sapiens
agcatgtgggcagacagaatcgtgggggcagaaggttcagcagacgcgattgcgggcaccagttaacattccagatcattcccggtaccttcattattagcctggataggggtaaagtacaaattaactcttttgtcttacaacggatattggtttgaatccagcagacattccctctggcccagaaacacccagggcagttaatcagggctaacctagaactgatctacgggtttctaatccgccaagcagtaatccgaaaaagtacacgcttcccacgatgacgtcgtgcccccaacgaacgcaggcacgcccaggcatcagcactttatatcttcagttttgtaggaagttctctgactggaagcaaacacaacgactcaaacctatcccaaagtatttttaaaatagtgtctttttttaaaaagtaaactagaaattgtcatcagaaaaatataaaatgatgtgtcaaactg

SEQ ID NO: 20277 - DNA, 713 bp, Homo sapiens
aggcctccccagccatgtgaaactgagtcaattaagcctctttcctttaaaaattacccaacctcaggtgtttctttatatcagtgtgaaaacagactgctatactttctgataatcatgcttaagcaattggggaattcagactacctgggatcaaactatggccccacccttagcagtcatgtgaccttgggggggtttacttaccttctctgtcccaacaacttctgtaaaatctgtaacatgagattgtttctgagggttaaatgagcatagcacagtggggacactgtcaggcacacactacttgccagatgtcgagtattcatctttattgaaataggactgtggtaagccactttatggctctcgattttgtatgagaaaatcatgtttagtgccttgttagtaaaagaaagaaaatctgaaagtccctgccatggaaggaagaaatagcggggagaaaagggagttggtaagtttcagcatttcagagcttggagggacaagttaggtttctattttatggagaaggaggtggaggcaggatgggtcctaaggtgtcattcaaaacacacagccataactctttattgagagtagagctagggccccagggattgctgtgatcaagttgcggacaaaaatgaccactcgttggaagacaggagaggagtgtttagttacaaaagcagtcaacaattcaggtgtat

SEQ ID NO: 20278 - DNA, 358 bp, Homo sapiens
ccagccaagttctctcagctcaggccaccctgcccagtcacatggcaaggacccatggatgagcgcttgacgcacttgctctcctgcatccaagtcacctgcctgcctccctgtcaaacccaccatgttcatctgcccccaccactgcaacctccatctcctgggctcaagtgattctcctgcctcagcctccagagtagctgggattacaggcatggtggtgggcacctgtaattccaactacttgggaggctgaagcaggagaattgcttgaacctgggaggcagaggttatgagccaagatcataccattgcactccagcctgagtgacctgactgagactgtctcaaaaagagt

SEQ ID NO: 20279 - DNA, 314 bp, Homo sapiens
ccagccaagttctctcagctcaggccaccctgcccagtcacatggcaaggacccatggatgagcgcttgacgcacttgctctcctgcatccaagtcacctgcctgcctccctgtcaaacccaccatgttcatctgcccccaccactgcaacctccatctcctgggctcaagtgattctcctgcctcagcctccagagtagctgggattacaggcatgcaccaccatgcccagctagtttttgtattttcagtagagatggagtttcagcatgttggccaggctgatctcaaactcctgacctcaagggatccac

SEQ ID NO: 20280 - DNA, 424 bp, Homo sapiens
ttgtaactttcctcatcttacataagcaaatcaaacactgtaaaataaaaactagatgaaattaaacattatcacaagacatgaaaaagatgtgtgctgtcattttaggattcataataaagataaatcagttgtttttagcagtgtgctatgagtctatgaagggcatgacagataataggctcgaaatttctgaagttattgtacagcaaaatttgttttttcctcaggcattcaatctttttctccagtaattttgaacatgacaaactttttagtggatgcattaataatctataagtaatgggttgtcaggtgtcagttagataagattaaaagactgtttaagcattatccatttgcttctttgcatgagttttataggtcagcagaaataactttttgaattgtgggttgtgtgtac

SEQ ID NO: 20281 - DNA, 146 bp, Homo sapiens
cacgcttccacttgtaccttttatccctcccttttgccctctactggacagcattgctcagcatttacctcattcctcagcatttttccagtccttcccatcagctgttaccactccaccctgcaaagaaaactgcgtcttatctc

SEQ ID NO: 20282 - DNA, 343 bp, Homo sapiens
ccaaacggaaatagcatggcttcactcggctgagatgcccccaaggcttgggtttgcttgaagatgggaaaccccactctgttgtagtggacggtgtaaatactttagttcaggccggtgcatgagtcatgtgcttctcctgggtggctgacctcccttttactcaagactacgctttgtttttttaagatttttatttgcttgtttacttgtttacgtttcgtgcagcctggtggggtgtctggtcttgggttcatttctctgcgtgtgtgttggatgctagtgaccccttggaatgtatgcctcacgagaattggaatgtctttgcttaccttcgacaggg

SEQ ID NO: 20283 - DNA, 435 bp, Homo sapiens
accgacaaaaccgactcttgtaacaacaaaataccaaattataaacaggacctaagaccatgcaggcaggggttaagtgatacatgcctacacccaaagtgctggagttacaggcgtgagccaacgagcgcggccagatggtgagattttatacagcatcaaaagatcttggcggggcacggtcgtcacgcctgtaatcctagcactttgcgagactgaggcaggtggatctcttgagctcaggagtttgagaccaacctttcgcaatgtggcgaaaccccgtctctacaaaaaatactaaaaattagcctgtagttgcagctacttaggggctgaggtgggaggatggtttgaacctaggaagtcagggctgcagtgagctgagatcatgccactgctttctggcctgggtgacgaaagtgagaccttgtctca

SEQ ID NO: 20284 - DNA, 181 bp, Homo sapiens
gttccgtgcttgtaatgggcaggatcccagtgggcaagaagagtaacaggaaggaggtggcagctggcccagggttctcctgcttcctctgcatgtgccaggaattagagtctcgctctattgcccaggctgaagtgcagtggcacggtctccgctcactgcaagctccgcctcccgggtt

SEQ ID NO: 20285 - DNA, 552 bp, Homo sapiens
  misc_feature (548)..(548): n is a, c, g, or t
  misc_feature (550)..(552): n is a, c, g, or t
gcgtttcaggaccgtggctatggagtccggcgtggcagcggcaatccctggccaaaggtacttggggtcattttccgcggggggttacgtgcgggagcgtgtcctccacaaacggattttccccccttaagcggacttatttccatccggagtgacagaatttaattccaaaccgagagctttccagactgacgaatttttaccgggactaacagagaattacctcagcctgacaacattttatctcgtgcgccacttcgggatccgagtggagccgaaagtcgagatagagcgcagttgggccttgggttcgaaaagactggacagaggtttcagtgagccgagatcgcgccactgcaccccggcctgggcgacagagcgagactccgtctcaaaaaaagaaaaagaaaaaagcctggaaagaaattctgcggaatagaagtctttaagaaatgagatcgtgccctttaaaactaagtttaacaatagtgagggcttaataaacgataggtgttatctctgggttggaggggaataccttcaaaaanannn

SEQ ID NO: 20286 - DNA, 385 bp, Homo sapiens
gtttcagctctcccttggagtcccgggaaacgtatctcttgggatcaggagctgggatggaacccagggctcctgagatgggacaaagctatgctctgtgcacctgtcttgcctcctcactttgtacaatgagtgtgccttcagccaaaagcagaactggaaacatcctaagtgggccggtaacgaggctagctctgtcgactagttcaagacccctgagcgctttgggcctgaggttcctcagcttccaagtgaaaggcttcgacttggcattctaagagacaatctctgtgaccatcagtttcctcatctgtaaaactggcatcatgataactttgaaggtaattgtgaagattaaagggagtcatgcatgtaaaaaaaattg

SEQ ID NO: 20287 - DNA, 1119 bp, Homo sapiens
gtggtctattcatacaacggaatattattcagcaataaacaggaatgacatacaacatggatggaccttgaaagcattgtgttaagtgaaagcagccagacccaaaagcctggccaacatggtgaaatcccatctctactaaaaatacaaaatttagccaggcgtggtggcacacgtctgtaatcccagctactcaagaggctgaggcaggagaatcacttgaacctggcaggtggaggttgcagtgagctgagatcacgccactgcactccagcctgggtgacagaatgagactctggaaaagaaagaaagagagagagagagagagagcgatggagggagggaggggaaggaaggaaagaaaggaaagaaaggaaggaaaggaagagaatgtaagcaatatacatatatcacagtaactttggaaaataaagaagataaaaagtttccgttaagggagggaccatgtttgtcttattcattgtaacaacccttgtacccaacaaagtgcttggcacataggtgctcaggatacacatgttgagtgaatgagtaaatcatagatgcatcattgtaatagcacaagtttaagcatattggtgacttcttctccctctccaaacattaggtttatttattgtttttagtgcttttattctacttataaaagtaatacatgttgattgtagaaaacttggaaaattaaaaagcaaaccaaaaagaaaatgaaaatcacctgtgtttctaccacttacagaaaaatccactattgatattttatgtttttccttccaggttttattctgggcatatatatgtttggaggtgtgtgtatgtttggggaacctttgaatttggaagtaccaaggtgaggagagacttatggaatttagaagctttggcaggaactaagcactgtgtttcttagaatgagcagctctttctacttgaaaggctgaggcagaggatcgcttgatcccagggatttgaagctggctgcagtgagctatgatcacaccactactctccagcctaggtgacacagcaagactctgtaaaaaatgaagaagaagaaagaagaagaagaagaagaagaagaagaagaggaagaggaagagg

SEQ ID NO: 20288 - DNA, 504 bp, Homo sapiens
cccaggccagaaacctgccaaatcctgtccagtactatgatctacaaaacggatctgcctcaggaaagccagggaaggtggggctggatggagtgtgttccagctggaacatctgctctgggccaggcacagtggggaaagccaaggtggattcactatggccctgatctcatgattggggttttattctgggcatatatatgtttggaggtgtgtgtatgtttggggaacctttgaatttggaagtaccaaggtgaggagagacttatggaatttagaagctttggcaggaactaagcactgtgtttcttagaatgagcagctctttctacttgaaaggctgaggcagaggatcgcttgatcccagggatttgaagctggctgcagtgagctatgatcacaccactactctccagcctaggtgacacagcaagactctgtaaaaaatgaagaagaagaaagaagaagaagaagaagaagaagaagaagaggaagaggaagagg

SEQ ID NO: 20289 - DNA, 506 bp, Homo sapiens
gcgtttcaggaccgtggctatggagtccggcgtggcagcggcaatccctggccaaagtgtgccttcagccaaaagcagaactggaaacatcctaagtgggccggtaacgaggctagctctgtcgactagttcaagacccctgagcgctttgggcctgaggttcctcagcttccaagtgaaaggcttcgacttggcattctaagagacaatctctgtgaccatcagtttcctcatctgtaaaactggcatcatgataactttgaaggttttattctgggcatatatatgtttggaggtgtgtgtatgtttggggaacctttgaatttggaagtaccaagagacaagaacttgctgtgttgcccaggctggtcttgaacttctggcctcaagaagatcctcccacctcgacctctcaaagtgttggtattacagacgtgagccactgggccccactgtgttctgttcttattgcccatgacaattaaagttagctctatctcatctcc

SEQ ID NO: 20290 - DNA, 355 bp, Homo sapiens
agaagtccgagaaacccccgtaaatatgcctgtccactttttttaaagcaaattacaaaatgtgaaattccccagaaatgcacagcaataccttctctaacaatgtgccttcagccaaaagcagaactggaaacatcctaagtgggccggtaacgaggctagctctgtcgactagttcaagacccctgagcgctttgggcctgaggttcctcagcttccaagtgaaaggcttcgacttggcattctaagagacaatctctgtgaccatcagtttcctcatctgtaaaactggcatcatgataactttgaaggtaattgtgaagattaaagggagtcatgcatgtaaaaaaaattg

SEQ ID NO: 20291 - DNA, 510 bp, Homo sapiens
ggacctgctggcaaatccccatggctccagcaccaggcctgtctggctcctgaacctctgacctactgctgctcatccatatctatctcctgagacctcgagacatgaatccaccttgggtaacctgtaaagacttatttgcctaaaacctgcccaggagtcttaatgtccccatcccgttttaatagatgaacactttgcttttggaaactttctgttccttggatattgatggtcatattgcttctggaatcattacagtgtgccttcagccaaaagcagaactggaaacatcctaagtgggccggtaacgaggctagctctgtcgactagttcaagacccctgagcgctttgggcctgaggttcctcagcttccaagtgaaaggcttcgacttggcattctaagagacaatctctgtgaccatcagtttcctcatctgtaaaactggcatcatgataactttgaaggtaattgtgaagattaaagggagtcatgcatgtaaaaaaaa

SEQ ID NO: 20292 - DNA, 909 bp, Homo sapiens
cgtggctcagcccagctgggcaggtggaatgaagagagcagtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgcgtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcagattttaaaaaaaaaaaaaaaaaaaaaaaaacctccgaggccatcaactagtcaggctgccgcgaaacagcggggtcagcgaagggggcccagggtcatacgcgaggtgaccggaagccaggctgctgtgatacaagcgggacaaaccgcgcgggccccctaaagggagccggatgacctcgcaaaagccggttacctgctag

SEQ ID NO: 20293 - DNA, 535 bp, Homo sapiens
atatcttccttatcagaatgtaagctctgcaggctaagtctgcatttcgcatttcttttgcttccgtattctcagcatttggagctctacctgacagatgatacattcttaacaaagagttgtggaaagaataattgaaccaggattccataatcaatatgcagcaaaacttagcacattggtgccaactagcacttagtaagctggaatctgcctatgatttttaagtgaatcaagtaaaaataattctaaagattattaatgtttctagcctccttggagaatcaacaaaaacaagagttaagaaactttagctggaaaaacagaactactattcaacccagcgatcccattactggggatatacccaaagaaatataaattgttctatcataaacacacatgcatatgtatgttcattgcagcattattcacaatagtaaagacgtggaatcaacctaaatgcccatcaatgacagattgaataaagaaaatgtgatgtatacacaccatggaatactatgaagccataaaa

SEQ ID NO: 20294 - DNA, 298 bp, Homo sapiens
gcttcagcacatgaatttggggtgggaagaaggtacaacgtttagtccataacaagtgagcaggtctaatctccttgtcaattctacctcccctgggtaaatagactaatggtatttgctagaaggaagagggttgtctttgggcccttagtaggatatctgactaaggattacctataatagatagaaccagaatttataagggatggcttcctggaaaatggcatatagtgtttgcagtgctggggtataaaatggagatgttttataattgaagcattaccaactgtatgaggaa

SEQ ID NO: 20295 - DNA, 471 bp, Homo sapiens
gtagagacagggtttcaccacgttggccaggctctcaggccatctgtcccccttgccctcccaaagtgctaggattacaggtgtgtgccactgcgcctggctgcctttttgtttcttgagcctgtttggcatttgtgaagggtacggtaaacttttccaggccacatacagggtgcaaggttttgtctaattttatccttttttttcctttttttttggagactgggtctcactctatcacccaggctggggtgcagtggcataatcatggctcactgcagccttgacctcctgggctcaatcaatcctcccaccttagcctaccaagtagctgggactacaggcacctgccaccacacctgggtaattttttgtatttcttgtaaagatgaggttttgtcgtgttttcccaggctggtttcgtcatgtttcccaggctggtttcaaactcctggggcagccattccacca

SEQ ID NO: 20296 - DNA, 386 bp, Homo sapiens
ccctcccttgacacgtggggattacaattcgagatgagatttggatggggacacagagccaaaccaaatcaataggtattaattttgtgtacctaatttatgaaacttttagcctaaaattagttcagtattttcctttttaccaaccctatgaaataggtgtattttcctcattttatatgtgagaaaactgcaacacagataaataaaagaatcaactccagttcctataattattaagtttcagggttatgggttaaaattaattctgtttatttccaaaacagatgcctttcttaaggaaagcatcacacagataaaatcagtaaaagttaatatgtcttatgtttttctcattaagaaaaataaaagtttttttcctaaca

SEQ ID NO: 20297 - DNA, 322 bp, Homo sapiens
gctcagagtggaggcggtgggtgggggtgatttggcccatggatccctgatgtgtgctcatgttgaagagtgggattcctccactgtcctgtcctgtcagggtagccaaggaagggcttctgcttccagtgggaatgagacatgatgacctttacagttccttctaactttcagaggttgcacactgcagtagtaaagtgcacagagtggagctagcctggatgggtttgagtcctggctctctcacctgtcagctctgtgacttggggccagtgacttaacctctctgtgcctcagtttcctcatctagaaaaaaatagag

SEQ ID NO: 20298 - DNA, 467 bp, Homo sapiens
gtgacacaagtactcatgtttattggccaaagcaagtcataccctgaccgttgtggagtgaggacggcaatagggaaatacattccctgccctccccaggagaactgggatatttgtgaacctgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaataggaaactgcagtatttcattataagcttttgaagattatttaccatgacaaaaaaaaa

SEQ ID NO: 20299 - DNA, 371 bp, Homo sapiens
gtttcagtaaacacaatgtgaatgttggacatttgaagatatgaatgctagtttgtatgtcagtgtctgtgtatatgtatttatataaatgagtcattttatatacaaatatatgcatttatgtaaatttgtaaatgtaagtataaacatgtttactgtcttggtgtttgagatgattccatttgtggtgaatgatggtgacttctgttttaaggatgtttggaatgatttaaagtaaaatcctgttcctaaatctaaagattgtgataattttagatgaatacttttcccttttcattattattttttggtgtctaccagaatatttatacatagtgatagaaacagtgattttttttgtatggagagaa

SEQ ID NO: 20300 - DNA, 293 bp, Homo sapiens
cttatgttgagtcagtattgcaatatgcctcgaacgagtagttaatacaatgattgccagaattaatagaagaataacttcacaacatacttactcctgtacttatggcaagctgatatgaatgaagatggaacagaaaacttgactgctcacacggtttgataatcactgaattctactctgtgcttctgatatctcagttccttaagtgctttttaaaaaatgtgaactattcctgcaagagatgatttggtcaagcatggctaagagagtagactgttttcattcagtga

SEQ ID NO: 20301 - DNA, 224 bp, Homo sapiens
aaaaagcctggtcgactttgcagactatttggactatagattggaatataggtgcaaagaagtagatttactgtgtccaaatgcaaaactaatcaactcagaatgacaatttcatatggttatgcccattacaactttgtttgacttctctcatctctttgagtatatgggatgtcattaatgttaccagctgcatgactttctctgaataccaataacagagg

SEQ ID NO: 20302 - DNA, 366 bp, Homo sapiens
gtaaagacaaaaaatgttccagcaggcccagaagaggattctcttgaccttaatggctaagttttcatttaagttcctagaatgtagaaactagaatttgattgcagagcactataataatatttgaagtctgttgtattattccaggctttattaacaatagagcaagtgtattttaattacatactattggcctagtaactcttcatgcatgtttgttgtattcagaaagtcccaagttaattaattcctctgggtcagtgtctctcaaactttagtacatattagaatcacttggagggcttgttaaaacatagatttctgggatccatccccagaatttctgaatcattgtgtggagtggag

SEQ ID NO: 20303 - DNA, 532 bp, Homo sapiens
gctgggctgcgctcctgaaatgcgtgaggaagcccagcctgggccaggatacgccgctctcagtgaagaggtcgaagatggccctcctggatgcgccatagtaatacgcggctgccacaaactcctgcagggacaggtgggtgaagcagtaggccactgacgatgccaacgtctcctctctctgcaggaagcagctgcacggggcgccctgcagcagagcgaggtctacaccaaacgccttcatgtcttgctcgtaaaacacgtatttcttcttgagcagcccatggaaggccagacggcccaatgtccccaccatcttgcggccaccatgggccacctgctcgatgcgagggcttgccttgcccttctcctgcccctccccgctgagggccatcctaaagtaccatgagtagagctcgcacagggtcctcgggggccacagctctgcatcctggggccccgtcctgctgcgccacaggtggcctagcgccatccccgtgagcctgcagaaggctgggacggtgcacatcag

SEQ ID NO: 20304 - DNA, 140 bp, Homo sapiens
aggaggcagagctcaggaagcagtgcttgctcgcctgctgctcacctcctgctgtgcagtccagttcctaacaggccacagacaagtaccagtccacagtctgggtgttggggttagacagtgttagcaattattattaa

SEQ ID NO: 20305 - DNA, 890 bp, Homo sapiens
ttaagtatattaggaagatagtatggaaataatggagattttgtttagaaattcatttctttgaggagagtaagcatttataatagtagatacagttaatggttaatgtaatttaaagtattttgtcttgttgctatttctttgtggttgggtaattggggattttggttttgtttgtaaatattctggaataatacttgcattgttctggtacttattctgagaaatgaatttttatgaaaagttctttccttccatgttttttacatacttactactgttttgtctcttcacactgaaaaacagtaagtagattcaaaaattttattgccttctataaactttccaataaatacaacctatagtcttaactcagaatttatgtagcattctgaagcacatttacattaagctttggttaactggctattatagttctcattatgacagacaattcagaggatttttaaaatctttgtttttacaactctattatggtttctgaaaaaattatacaacttcagtttttaaggttctgttaaaaaaaaaaaaagtgttcatagccattatacttaggcactaagttattccagaatcacttttgtaacttcccctttgtctgtcaaatgattgttattgtgggaatgtgcacgtaaggttaggtgttgctttagatactgatattgctgctggtagttcttacatattcatttaatattcttcatattgtacaatttctgtaactgattcaatagcagtatactcagctgattcttcctttatagcattgcttatcctttaccaatatttggcacttagaatatgttatctacataggaagataatagctgtgtggaatgcttactaatgaccctgaatagctaattctt

SEQ ID NO: 20306 - DNA, 608 bp, Homo sapiens
gaggattcagttgagcggccaggagcgggcaggcacacaggcttagcaaggataacctagctaagtgttgggaaagttccactttccaaccaaacccagcaacgtcagattctctttgggagagaaggacaaggcttccctggaggttaagttagatcttgaaggcagaagggcagagaaaagccttccaggcccacaagactccaggttcaaaggcgacaaggtttgagacaatgtggtgctctttaagctagcataactagtgtgatgtaccatgagcaaaaagggctttagcaagtatttataacagtttgtgggtttgaaggggtgacacggttggagaatgctgagttgctgggtttggttggaaagtggaactttcccaacacttagctaggttatccttgctaaccctgtgtgcctgcccactcctggccgctcaactgaatcctcctgggagcatttggggaacaatcaatcttggcatccaaagctcattacagtctgtttctaatctttctttcctctaatctcgtacatcaagacatctcaatcaggtgcagtggctcatgcctgtaatcacagcactttgggaagccgaggtggga

SEQ ID NO: 20307 - DNA, 525 bp, Homo sapiens
gcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaacataaaaa

SEQ ID NO: 20308 - DNA, 490 bp, Homo sapiens
gaaagatacctatagtaagtgaggtaaatttgaagcagttttcttaccaaaacataatctccatgcagtcaaatacattgtctggattacttttgtcttcctagtgccaagcacttactctagcacttagtaagcattcagtgaatatttgttgatacatcaaaagaatgaatggatgggaaaaacttggataaattattgttgatattatggacttatggcatagatttgataacactggtaaaattgcattgcacgtgaaaaaacaaaaatagttgcttactattgtgactgaagaaaagactttcattatagagatgtaatctgtataatgattcatattttcccatgtgaatacagtctgataaagatgggactatttagccttaaaagaattgctacttttaaccaaatccagcattgcctttttgcaaatacaatttttataaaatctttaataaaattaacaaaaaacaaagttagatgtaaa

SEQ ID NO: 20309 - DNA, 713 bp, Homo sapiens
caactgatgcttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttcta

SEQ ID NO: 20310 - DNA, 860 bp, Homo sapiens
atattcatagtaattcagaataactacagaaacccaaatatctaagtatttagttttgttattgaaacttagaactagctttgctccagtgatggactgtagaaaaataaaagctctgagtctaacattttaagtaaacttacttggatatgaaaataaatggacttttagacttactgacaaatgttacgtgttctccctgctctctatcctctccccataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttcta

SEQ ID NO: 20311 - DNA, 2908 bp, Homo sapiens
aaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggtttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtgatcccaaggtgctgggattacaggcgtgagccaccgcgctgggcctagatcaaatctttatccatgcacattggaacacaggattactgggttgaaatcattctagttttgtcatttagatacttgtagatgaatctattttagcacaaggtataaataactcgggaggtcatctctatcttctttccttttgtgcatttggctataccacgtttaggtactaaaacagctttgcttatgttggccaggggaaaacatggcattctgtgcgcaaagctaatgatcgccagccctgccttggcccctcccttgtttatggtcattgtaagatgcccgcatgttaaggcttaagctgtcactgggctgggtgtaatacccgcttcattcctcctcccaccctcttacccgaaacatgaagggcactgtgctctattgagatctcgataagatcatcattttaacttgtattcaactgagggaggtaacatgatatctgggtgctggtggattgagacctcaagcatcaattcaaaattgctgtcgaaaatatgcactattttttttttccactctggctaagtgtaggctctgaagccagttttatagcttgatacattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctacaaaaatacaaaaaaa

SEQ ID NO: 20312 - DNA, 835 bp, Homo sapiens
cggtcgatctaaggatccccctgatattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctacaaaaatacaaaaaaa

SEQ ID NO: 20313 - DNA, 541 bp, Homo sapiens
ttgctagaggatccccagtacacctccacaaactaggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctacaaaaatacaaaaaaa

SEQ ID NO: 20314 - DNA, 1625 bp, Homo sapiens
gcagtggcaccatctcggctcactgcaagctccgcctcctgggttcacgccattctcctacctcagcctcccaagtagccgggactacaggcgcccaccatcatgcccggctaattttttatatttttagtagagacggggtttcaccgtgttggccaggatggtctcgatctcctgacctcgtgatccgcccgcctcggcctcccaaagtgctgggattacaggcgtgagccaccgcgctgggcctagatcaaatctttatccatgcacattggaacacaggattactgggttgaaatcattctagttttgtcatttagatacttgtagatgaatctattttagcacaaggtataaataactcgggaggtcatctctatcttctttccttttgtgcatttggctataccacgtttaggtactaaaacagctttgcttatgttggccaggggaaaacatggcattctgtgcgcaaagctaatgatcgccagccctgccttggcccctcccttgtttatggtcattgtaagatgcccgcatgttaaggcttaagctgtcactgggctgggtgtaatacccgcttcattcctcctcccaccctcttacccgaaacatgaagggcactgtgctctattgagatctcgataagatcatcattttaacttgtattcaactgagggaggtaacatgatatctgggtgctggtggattgagacctcaagcatcaattcaaaattgctgtcgaaaatatgcactattttttttttccactctggctaagtgtaggctctgaagccagttttatagcttgatacattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctacaaaaatacaaaaaaa

SEQ ID NO: 20315 - DNA, 2417 bp, Homo sapiens
acagaagggacctgatagtgcgggttctggcccagaaggcctcaggggtggctgtgtagcaagatgagggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactggagtttttacgtaaccctgccatgatgcaggagatgatacgtagccaggaccgggtgctcagtaacttggagagcattcctggtggctacaatgtgctttgcactatgtacacagatattatggacccaatgcttaacgcagtccaggagcagtttggcggcaatccctttgccactgccactactgataatgccaccaccaccaccagccaaccttcaaggatggagaattgtgaccctctccccaacccctggacttctacacatggaggctcaggtagcaggcaaggaaggcaggatggggatcaggatgcacctgacattagaaataggtttccaaactttctgggtattataaggctctatgactatctccagcaattacacgagaacccccagtccctaggaacttatctacaggggactgcatctgccctcagccaaagccaggaaccaccaccatcagtaaacagagttcccccatcgtcaccctcatctcaggagcctgggtcaggccagcctctccccgaggagtcagtagcaatcaagggaaggtcctcctgcccagctttcctgagataccccacagagaacagtactggacaaggtggagaccaagatggtgcagggaaaagctctactggacatagcacaaacttgcctgatcttgtctcggggctgggagattctgccaacagggttccatttgctcccttatctttttcccccacggcagccattcctggaatccctgagcctccctggctgccatccccggcttatccaagatctctgaggccagatggcatgaatccagctccacagttacaggatgagatacaaccacagctgccactgctgatgcaccttcaggcagccatggcaaacccccgtgccctgcaagccctgcggcagattgagcagggtctacaggtcctagctactgaagcacctcgcctcctactctggttcatgccttgcctagcagggacgggtagtgtggcaggaggtatagagtctagagaagatccccttatgtctgaggatcctctcccaaatccacctcctgaggtgttcccagcactggactctgcagagctgggcttcctttcccctccctttctccatatgctgcaagatttagttagtacaaatccccagcagctgcagcctgaggctcactttcaggtgcagctggagcaactgcggtccatgggctttctgaatcgtgaagccaatcttcaggccctcattgctacggggggcgacgtggatgctgctgtggagaagctgagacagtcgtaggagccttattcattcaaaccatacgttttcctctgtgcctttttcccatatcctagttccctagctctcccatttttgaatacagctgcattataaaccaaatttactatgaagtcctttgctgtggaggcaatgttgttccagagtcaacgaggaagactaatggccaaaacatagtggaggtgctgtgtgtgagtcaaccacttgtaccactataccactggggggccccagtctaagctctgcttatgcctatcttgagatgcaattacacccaatttccaatgtgaaaaaat

SEQ ID NO: 20316 - DNA, 2450 bp, Homo sapiens
acagaagggacctgatagtgcgggttctggcccagaaggcctcaggggtggctgtgtagcaagatgagggaggtttggagccctgcataaagagaaggacgggaccacagctgactggatgatcttggtctccaatccccatgcccctagctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactggagtttttacgtaaccctgccatgatgcaggagatgatacgtagccaggaccgggtgctcagtaacttggagagcattcctggtggctacaatgtgctttgcactatgtacacagatattatggacccaatgcttaacgcagtccaggagcagtttggcggcaatccctttgccactgccactactgataatgccaccaccaccaccagccaaccttcaaggatggagaattgtgaccctctccccaacccctggacttctacacatggaggctcaggtagcaggcaaggaaggcaggatggggatcaggatgcacctgacattagaaataggtttccaaactttctgggtattataaggctctatgactatctccagcaattacacgagaacccccagtccctaggaacttatctacaggggactgcatctgccctcagccaaagccaggaaccaccaccatcagtaaacagagttcccccatcgtcaccctcatctcaggagcctgggtcaggccagcctctccccgaggagtcagtagcaatcaagggaaggtcctcctgcccagctttcctgagataccccacagagaacagtactggacaaggtggagaccaagatggtgcagggaaaagctctactggacatagcacaaacttgcctgatcttgtctcggggctgggagattctgccaacagggttccatttgctcccttatctttttcccccacggcagccattcctggaatccctgagcctccctggctgccatccccggcttatccaagatctctgaggccagatggcatgaatccagctccacagttacaggatgagatacaaccacagctgccactgctgatgcaccttcaggcagccatggcaaacccccgtgccctgcaagccctgcggcagattgagcagggtctacaggtcctagctactgaagcacctcgcctcctactctggttcatgccttgcctagcagggacgggtagtgtggcaggaggtatagagtctagagaagatccccttatgtctgaggatcctctcccaaatccacctcctgaggtgttcccagcactggactctgcagagctgggcttcctttcccctccctttctccatatgctgcaagatttagttagtacaaatccccagcagctgcagcctgaggctcactttcaggtgcagctggagcaactgcggtccatgggctttctgaatcgtgaagccaatcttcaggccctcattgctacggggggcgacgtggatgctgctgtggagaagctgagacagtcgtaggagccttattcattcaaaccatacgttttcctctgtgcctttttcccatatcctagttccctagctctcccatttttgaatacagctgcattataaaccaaatttactatgaagtcctttgctgtggaggcaatgttgttccagagtcaacgaggaagactaatggccaaaacatagtggaggtgctgtgtgtgagtcaaccacttgtaccactataccactggggggccccagtctaagctctgcttatgcctatcttgagatgcaattacacccaatttccaatgtgaaaaaat

SEQ ID NO: 20317 - DNA, 408 bp, Homo sapiens
gaggcaagggtcccccattttacacagaagagaaacagattcacagttgcctaagatcacatagctggccaggaacagaacgtggttcaaacacaggcctctctctagccagagcccaatgctctgtttaccatgcaactgaaacggcttgagtctccatccaaaatcattgagggctttaacgttgtagggagcctgttaaaggtttccattcttacctgccccactccctggtgcccagttttataagggcagtgaacggtgatggtcatttttgctctcgctttgaaatcaagtgagcttggctgagggcctggctatcccagacctttagagcaggaagtgcctgcacccttggctacctaagaagaaagtgggttccctataggtatgggctggggcttcaca

SEQ ID NO: 20318 - DNA, 371 bp, Homo sapiens
atctcaaaccaaccataggatccttccccaaattctttccctgctgtttatcttttgatattgcaagagctctgatgggtcccttgtgtagtggtatcttttggcaaaagtggtttcctcaggttgagttgagctctggctcttcaaagttaattagaaccacaccacacagtatctcgagtatgctgatagaaaatgcctgtggtgtgatgttaacgagagacaattaaatttctctttgttctcttcagaagacaattacatttctcatcttttatttgcataccagccactcaataaaaaccagcctacagcctagtaaaaaaaaggccaagaatgggccttgcccacagctgcagctaccacccact

SEQ ID NO: 20319 - DNA, 305 bp, Homo sapiens
tttttttttaagagatgaggtctcactatgttgcccaggctggtctcaaactcctgggctcaaaccatcctcccacttcagcctcccaaagggagcagcattcctcatctacttaatttcttatgagcaagcaattggaactgctcctttcctttttcataaggagctgtgtcccttgagggaaggccacaggtgctgggaccctacagcctgggattcagaatctcaggccctcacttaccagctgtgtgggctgggtaaagttactctgtctgagccttggttttctcacctggaaaataggg

SEQ ID NO: 20320 - DNA, 213 bp, Homo sapiens
ttatataaaatatgtagagagctagattcttcactttggggattagactcttaagaatatgggagttgaggccgggtgcagtggcttgtgcctgtaatcccagcactttgggaggccaagatggcaggattgcttgagcccaggagttcaagaccagcctggccaacatagcaagacccccatctctataaaaaaattaaaaattttttcata

SEQ ID NO: 20321 - DNA, 376 bp, Homo sapiens
aactgcttgagcccaggagtttgagaccagccagggaaacatagtgagacctcatctcaatttattattatttttaaagcttatttctgaaaacatatacacatacttctaaactagtccctagaccatcatgtcttgacagaaatactgtggaagggggttaaggaaaagaactcagatgtacactcaagacacaggatggagagaaggaaaaatgtctttttgctggttaactagctcaaatgctccaaatcaaatatacatgctaaatttaaaaaagagaaagaaaagaaaaatcaggtactctgaaatgtctttcatccacattcattttccttagaactacatcaaatctttaaaaagttttatgagattc

SEQ ID NO: 20322 - DNA, 278 bp, Homo sapiens
aaggagtgaatgttttcctgcactctcacccttccaggacttaatttttttaatttctatttaaaatgatacagaagttggccaggtgcggtggctcacacctgtaatcccagcactttgggagcctgaggtgggcggatcatgaggtcaggagttcaagaccagcctggccaacacagtgaaacctcgtctgtactaaaaatacaaaaattagccagatgtggtagtgggcgcctgtagtcccaactacctgggagactgaggtaggagaatccctt

SEQ ID NO: 20323 - DNA, 602 bp, Homo sapiens
aaaacaaagaaaattgccaatgggctgtcattttgtttaaaaaaaaaatttttttttttttttgacttggcactggcccctgctgccttctggagaagtcatcaaattcagtgggaagaaatgtcaaacatatttactgtgtgtcttttgccagccatagaaacttaaaaatttaaacttactccattgattgaagtgaattatgaagcttagctttcctatgtggaaagtgtggaaaaggattggaattaagtatatgtaagactttctttgctttagagttatagctggtatctcagttaaaataagcataattaaggcggggggtggtggctcatgcctgtaatcccagcactttgggaggccaaggtgggcggatcacctgaggtcaagagcttgagaccattctggccaacgtggtgaaaccccttctctactaaaattacaaaaattagctaggcatggtggtgtgtgcctgtactcctaactactcaggaggctgaggcaggagaatggcttgaacccaggaggcggaggttgcagtgagccgagattgtgccactgcactccagcctggcgacagagcaaaactccatctcaaa

SEQ ID NO: 20324 - DNA, 375 bp, Homo sapiens
ccttctctactaaaaataccaaaatcagccaggtatgatggcacatgcctgtagtcccagctactcctgaggaggaggaacgagaattgcttgaacctgggagacagtgagctgagatcgtaccactgcactccagcctgggcgacagagcgagactctgtctccaaaaactcccaaacacctcattttaatactttcatattaattccgtgattcttaaccctgacccacactttagaatccctggggagttctttaaaaaagctactgattatattggccccaccctaaagtaactggatcaggatatggacagagttggaaatcgctgcgtcgggattgcttttgtagtaggatggcagctgccttttatgg

SEQ ID NO: 20325 - DNA, 433 bp, Homo sapiens
tgtaagccccacaatctgggaaaaaatatttacaaaagacttataaaggtctgttatccaaactataaaagaactttaaggaatgcaaacaacaaatttaaaaaatgagccaaagaccttaacagacaccttaccaaaaatgtatagatggcaaataagcatatgaaaagatgttctatatcatatgccatcaaggaaatgcaaattaaacaacagtgatatacccctacacacccattagatgaccaaaatccagaacactggcaccaccaaatgctggagaagatgtggagcaacaggaatgctcattcgttgccagtgggaatgcaaaatggtacagccactttggaaaacagtttggcgattttatacaacattaaatatgctcttactatatgattccacaatcatgctatttaatatttacccaaag

SEQ ID NO: 20326 - DNA, 732 bp, Homo sapiens
gtgagaccatggacatggctgtgactgttaagggaaagaagaatgacagaagggcctaaggctgcttggtgggacatcaacatttaatggccagatacaggagaataagccagccaaaaaaaaaaaaaaattgagagtggtaggaggaaaatgaagaactgtcacgaaccattaagcaagaggaaagagcgtctcaagagtaagaagtcactccctgcaggttgatgtgtagttggggggttggggaggacatggattatgggtactactcagcaggccagtttttactccacctctttctagctgacttgacacaagcaacaacccaacagaaaaccaatacttctgagaatggctgcaagtttgtttgtgctgtcttttgaggtaagaaatcaaggctgagctcttctttctcctaattctcaggaaggaggaaggcagatgtgagaacactgattgggtctgagtgtactgggcagcatcactgttaaaaggtcagcacacagatgcaagctcacttgtctgcttctttcatgtgactgaagtggttaagaaggttgtcaactcccccctgcacccccctcaccaccgcagtaagggagagacagggccaaacctgcagcttcggtagaagaggccaaggcaggtgtccaaggccagatcagcagtcagccagggcaaatgggctcactctggttacatgacctcgagcaactgacagaaaggagtgaa

SEQ ID NO: 20327 - DNA, 510 bp, Homo sapiens
tatgcagaaactcatttcactacatcctcatatcatgactctgtttactcccatccccagggcctaagcaaggccctgtaaagcgtcgtcttcagcccccacattcactgctgctcggaaacagcactgctgcactacctttttggaagtgggatctcccacaaatgctgatttctgaggagactccctttgacagctcttgactggtgcccttcaagcagtatgggagccagctaacagtgtggaggtcactggcaccaagctgttctgatgagagtagaacacctgggaaaattttcttctgtccatttcagatgggtggtgtttttccaatgacagaagaaaagtatgtaaaaaatacttaaacccttccctacacttaataggtatggtagtagactcctttgggctcactcattgttcttgcttctcagtaagtgacaatgattaaatatcattcatttttcagtgttaactgtgtaaaattaataactaatgaccaaaaaaaaa

SEQ ID NO: 20328 - DNA, 355 bp, Homo sapiens
ggacctctgcgttctgggccaggccttgggaggattccgctctgtcctccttccatgtctggtctggatgccagactaaatgtcagtagatttcagtaaaggctcagcgttgatgataatgcatgagctcataacattttataaccagtggaaccgtaaaccatttataaacatgaaatcctattgatttagagaaccattaatcctagacaaattttgacattttggaaagacagaaacagccaagctatattatctggagttttaaaacaagttcaggacccatctaatgggccatttcatgttttaaatccactgttccatttttctcattgtcagtgactctaatattact

SEQ ID NO: 20329 - DNA, 1051 bp, Homo sapiens
ctggtgttgaactcctaacctcaggtgatccacccaccttggcctcccaaagtgctgggattacaggcgtgagccactgcgcccggccagattttgtgtatttcttatagccctttacttcactgcgccactgcctggtgtagacatcacatatcggagctaatacacgacactggcaacaaggctgaatccttgaactgttgtcgcctgttgagaaaggattccttttccggaacagaagtgcagaggaggagagagcggagagttaaaagctggcacccaggcatgtgcctgtctgagaaatcagagccgtgctcctgagcctcggtggggtgagaacgacagggccgacctcccagctgcaaacacaaggacactgagatgcacagaaaggagagtccacgttgaagaaacccacgttgaggggcctcttctccctccgttcccagctcggtgatggtgaagggtaaggaaatggatcctcccattgcaacattaaaccaggccaaacctgtatttttctcttccttcctttttcttgttttgtaattgatgtctcctcgggactactgataatgtcctagaaagaataaaataaagtttcccaaggctttgtgactcagagctctttggaggtgttcaccgaatgcacgggccgcccggaggccttggccctccagggaaacaccaccagaagtccccagaagcggaacatgtagcaaggaggctccccgagatctcccagagggagcacagccctgccaagttattggttttggacttccggcttccagagctacgagaaaataaatatttgttatttaagtcaccaggtttgtggcgattgttacggcagcctcaggaaactcctacaaggaagtgagttacgctcacggcagaaagtgctacagcaaaccaaggcagaacaaaaacagacgaaacctaatacagaccggactaagtagaagactgtgtgtttgggtggtgaatatacaaaaaacataaatataaattaaaccttagagaaactttgtcattttcttgtcatgtt

SEQ ID NO: 20330 - DNA, 450 bp, Homo sapiens
cacctgggcacggcagccacggggacaaagtccacggggaggcaggggtgtggtctgtgggcagaaggtgaaccctgaggggacagtgtctggagagggtggccagcctcgtgcaggcacgctgcaaagacctgtgcacccttctctctgctgtgccacaggtggggtgagaacgacagggccgacctcccagctgcaaacacaaggacactgagatgcacagaaaggagagtccacgttgaagaaacccacgttgaggggcctcttctccctccgttcccagctcggtgatggtgaagggtaaggaaatggatcctcccattgcaacattaaaccaggccaaacctgtatttttctcttccttcctttttcttgttttgtaattgatgtctcctcgggactactgataatgtcctagaaagaataaaataaagtttcccaaggctttgt

SEQ ID NO: 20331 - DNA, 515 bp, Homo sapiens
atgaaatcatatcctttacagcaacatggatgcagctggagaccattatcataagcaaattaatgcaggaacagaaaactgaatcctgcacgtactcacttataagtgggagataaacattgagtacacgtggatacaaaaaggggaacaatagacactggggtttactagagggtggagggtgggagattggaaaactacctactgggcaccatgcttactacctgggtgacaaaatgatttctacaccaaaccccagtgacatgcaatttacccatgtaacaaacctgaacatgtaccctctgaaatgagaaaagttggaaggaaaaaataaaagaaattaaggttactaagagtatactaattctatatacagagtgtataaggaaaagcaagggctgggtgtggtggctcatgcctgtaatcccagcactttgggaggctgaagtgggaggattgcttgagcccagaaattcaagaccagcctgagcaacatggcaaaaacctgtctctac

SEQ ID NO: 20332 - DNA, 2107 bp, Homo sapiens
gaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacactatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagcctcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgtactttagtgccccttcacggtacctcgtgtggggtggggactgagaactctttgagatgaaaaaattt

SEQ ID NO: 20333 - DNA, 206 bp, Homo sapiens
taagaatacaatgcaacaaaatattcatatattgcacaaacagtgatgtgcatacaaagatgctaacaacattggctggtaataggctttaccatgttatcatctttgtatgcacatcactgtttgtgcaatatatgaatattttgttgcattgtattcttatataaaaataagtagaaaacataaaattgaaattgctgatgaga

SEQ ID NO: 20334 - DNA, 3861 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20335 - DNA, 3807 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20336 - DNA, 3474 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaagtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20337 - DNA, 3808 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagctgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20338 - DNA, 3195 bp, Homo sapiens
tttctgctggcattgatgataataatatttatttcttgggtgttgtgggggttaaatgaatgaaaaataccatagctctcagaactctgcttggtgcatagggcagcctgttattacagtcaaggatggagatacccctcctcagataaggggagtgattcagagaggagaactgtcttgctggagttccacagatgctaagtggcagggctgagagcccaaacctttctcttatggtttgttctttccactccctgatgcagaagcgcttctctgtccctttctcacattattctattcctctcttcagtctctcagtgacagccacacaggattcagtagtttcagtgctgaaggggagggggccaccaacccagggcccctccctctcccatcgtcttttcccttccccttccccttcccatgcaggctcctgtgagagaggcaggtggagggaagctgctgagcagcttggcaggtgacagtctggtatcttgacagcttatccctctttcctccaattccagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20339 - DNA, 3661 bp, Homo sapiens
aaatggctcctgattggtaaattgcatctggaactgggaggatctgtacaggaactagaaatacttgaaagggacagcattctttgggctttcctgagggcattgactctggcatacctctcatggtgaccctggaagctccgcctctggagttgctatgagagaaattgctcttgtaggacatgaggtttttcaccagcgtggcctgctatggatcttgtctctttgcatctgagttgctgatcagatgcaaggactggctcaaaggaagaccagctctcttcactgccctgctagcttgtgtcctttatctttgtgagtggactggtgccaagcatgtcccagggtcatcttatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20340 - DNA, 2910 bp, Homo sapiens
ccacgcgtcgcggacgcgtgggtcgacccacgcgtccggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20341 - DNA, 2884 bp, Homo sapiens
acagtagttaagaacagccagggctctagagctggcagcctgaatttacatctttattctgctatttgatgaccttgaccttgctgtgcctcatatgaaaggggaggactaggtgatataagctactgtaagcagcataactggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20342 - DNA, 4209 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgagaagccttgtctcgtgaatgtgatacacttgagacacggatggaactgatcaggagtgccaagtcaaaagcagcagatcttaagccctcactggttgttcctttaacatccaaaatggttggttatatgtaaaagaagaaaatgaaataatctggatgaaacactgggactgtgttatcaaagaatgtctgtagtgatgaggtgaaaattttcattttccagaaacagaactgctcatttataacataaatatattcaacttccacatactcaaacatgtgtatacatttttaggagtacattatgtaacaaaaccatggatttccaatacaatgagaagcagaaatgac

SEQ ID NO: 20343 - DNA, 3716 bp, Homo sapiens
  misc_feature (3702)..(3702): n is a, c, g, or t
  misc_feature (3707)..(3707): n is a, c, g, or t
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttaaatcaaattcaagtttgcccggcacgaggcctcgtnaaaanttcttggcc

SEQ ID NO: 20344 - DNA, 3832 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccgcaaacttgaatttgatttaaaatagggctgggaaaaatattcaataactgtaagcccccttttggatgccaaacttagaattttgtacattctctgatgaacaagcatttagatcataacatggtaaagcctattaccagccaatgttgttagcatctttgtatgcacatcactgtttgtgcaatatatgaatattttgttgcattgtattcttatataaaaataagtagaaaacataaaattgaaattgctgatgaga

SEQ ID NO: 20345 - DNA, 1668 bp, Homo sapiens
cacgagggcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggtgagagctgggactccaccccacctatcctgtcctaggggtcgtttcatcgcaagagatagaaacccaggtgaaaggagccaggcacaaaaggtcatatattataggattccatttatatgaaatgccagagtgggcaaatccacagagacagtttgaagattggtggttgccagcggctggagggaggaggaatgggaagaaactgcttaatggggacaggtgtattagggttctctagagggaca

SEQ ID NO: 20346 - DNA, 1962 bp, Homo sapiens
attacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcagaatctaatttaattttgattgactgaagaaccagggtcttttgctctcctttggtatttcactctcctttggtattcaatcatgtgtcttttagtgctttttaaaattttacccattctttaattcagcatctccctatgtatgtgtcatagaatacttagttctgctagatattctgcaaatatatttgggaattacttcctgctgtttcgccttcttaggttcatagtacacatcagcatatgagaatctctgagaggtcctctagaaaggagagaaaaagcacctcttttggctcaatgttttccaaacttatttgaccccaaaacctttttcatatacccaataataagctacagaactaatattctgcaaatgtctcttggaacacactgccttaaacagatatttctatagctgtcagtatagttatgttgctcccaagcctagttatctccagttgttttaagggtgttatgaaaaattcttaaaatatatatgaatttgtgtaacacacacagagacacacacacatactactttaagggggtgaggatcattaattcagataatttttaagtttcctagtgattctcaatctctttgaattttacttacatttacacacacacgcacacacatatgtatatacacatatcattttaagaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatgtgctcttcctgcttcacttgcactaattaattatttgaacaacttagagcttcttccctgaacagtggcaacaagcatggcaattgactctgtcctcatcccaagttggaatcgcttttctctctgcaaccatg

SEQ ID NO: 20347 - DNA, 396 bp, Homo sapiens
ctcgtgccgaattcggcacgagattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20348 - DNA, 2433 bp, Homo sapiens
gacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggcggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20349 - DNA, 1995 bp, Homo sapiens
cttccctccccgtgtccggtccccgtgcgtcccgaggctccccgccgcccgtcccggcgcgcaccgcgggcgtctgtccgaacgccttccagccacctgagccctcctgcgggcgactcgctcagctagcccgtgcccgcctccaccttctccgtcatcccctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggcggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20350 - DNA, 1536 bp, Homo sapiens
ctttgaaggataggactgagaagtcagaacaggagcaaagcatagtggtgtgaaagttgccaaagatgggcatggtggaggctcaagtgtagggtcaagtgtagggtggatcaggggagtagcaggagatggtgtggaaaaatgtttggggtcaggttatacagggctgttaaagcctgccgaggagtccagactctaaatggatgaacagcaaaggtttaaggggtgaggcatcactagatcagcccaaaacctccatccacctcttctccaccaggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20351 - DNA, 1108 bp, Homo sapiens
acagcagttagttgtgttagcgtctgaaacttgctgagtgtcgttactggtgtagattatacatgtcatgatgtattatatggcaatcatagatcaagcgtttccttcttccgtaccacaaatcattacagtcattaagtgttgccataatgaaagacatggagacatagcataggaaatgacagtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20352 - DNA, 692 bp, Homo sapiens
agggttcttgcggtgctcgttgagccaggccttgagggtatccttggcgtcccgattttgacgcgttctccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20353 - DNA, 2243 bp, Homo sapiens
gacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggcggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20354 - DNA, 2173 bp, Homo sapiens
gacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggcggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttaaaa

SEQ ID NO: 20355 - DNA, 417 bp, Homo sapiens
aaggaaactctgccctgtgtctgtgtgccccagccctggactaaccccttgccttgtttcatagctctccacaatcatagacatgttggaaggagcgttctatggcctggatctcctgaagctacattcagtcaccaccaaactggtggggcgagtggataaactggaggaggtaaggaagattctggtttctatatctttttcttgattgagcccaaaagcatatcaaacgtcccacagtaaattttcagctagcacatgtgctgactagacttaacccatcctattctatgaaagggaaaatatacataaaagattcattcaaaattatgccaaattgttggtgacaaagaaaatcagttaagtagaaatgccaatactgtaccttctttttttcataaaatccccttaatcata

SEQ ID NO: 20356 - DNA, 5320 bp, Homo sapiens
tagaattttcagtgaaggtatctgtcagtatttatggcagctgggtgcttcttgcccttctttaagcagttcagggactccaaatctgtcaaccgttgtgagtatggaagagccctcattacgggtgagagggatgcttactttaacttcgaaggagggtataatttctcttaaaaaaggaaacattgtacttaacccgactacctagtgcatagtactggttgagtgagtgaactaggtttttgttgattgtagtagtggtggttttgttggttttgttgtgtttttctgctttttggttgaacgtgtaaatgaaggcctgaggtgatttaattatttgcaaattcagtaagtaaaatattttcaaaaagagaatattacagaaatctgaagaaaggctgaaagtggcagtgaaggtatttgttagataataattgggaagaatttcctggcagaatagttcaaacattttctaaggttccaaatatggttgtataatctccttccatggcggtctttaaaagaaagattatttctttccttgaaatattttaaaggtgagtctttctgtagcacatggtgtagtttgtagcattctgtaatcatgtcagattcaaaaagtgagataaacttttatatttatttgcagaaggatagctaatcattctcaataagaatatttaaaatagtgtaggatgaagggattgtttaaccactgtaccacttataaactattaatctttatttgggattaaaaatatcctagcaggtttttttttttgtttgtttgtttgttttttttttttttttggagacagtatctcactctttcacccaggctggagtatagtgacatgatcacagctcactgtagccttgacttccgagactcaagcaatcctcccccttcaacctcctcagtaactgggactacaagtgcatgcctgtgtacccagctagaataataataggaaatagtttattctctcctcatctttttttttttttaatagaaaggtgttaatctttacttggaattaagaatttgctactcagtatttttttttttttttttgagatggagtctcgccctgtcacccaggctggagtgcagtggtgtgatcttagctcactgcaacctctgcctcctgggttcaagtgatcgtcctgcctcagcctcccgagtagctggaattataggtgtgtgccaccatgtctggctaattttttgtatttttagtagagatgggatttcaattcaccatgttggccaggctgatctcgaattcctgacctcaagtgatctacccacctcggcctcccaaagtgctgggattacaggcgtgagccaccatctccggcctgctagtcagtattttaatagaagtttggtaattgtatctcttgttttaaaaaaacactaattattagaaatggattgtgtctgtaagtatatgtatatacataaatatgccacattttgtaatttcttgtcaaaaattatccaaattctaggaattatatgtaatgaaaggagcacagtaaaaaagctgttcattaggttctttagggattctcattttttaattgaaaaaagacatttgtttaattgaaagttgttgacattgatcatattaatacagaaaatgttgagtgattatacttaggggttctcattttttaactgaaaaaatcttatttgtttaattgaaagtggttgacattgatcatattaatacagtaaatgttaagggtgattatatatagtagtaatgtgtgcttttaaaactaaacatttgaaaattaaaagaagaaagattgtgaattttttgttagatttagtttttcctttttattacaaggaatacatacatacaaattaaattattgccataaatgaagaaattgtcatttatgtagcatttgtataattttattacttacctttaggcattactatcacgttaacttgggaagatagaaatgactagagtaaattttctcttctataatatttgtctagttgtgttttgtttttttttttttaatcctgtagtttaagaatgatgtttaaaaaacacttttgtttctctcagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactga

SEQ ID NO: 20357 - DNA, 2605 bp, Homo sapiens
cagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgta

SEQ ID NO: 20358 - DNA, 591 bp, Homo sapiens
aaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagtgagtatttcagtttttaccttaaccattgtttgtaacttggccctgatagtttgctagttactctaaattcttctggcacttgtagaaaaacttttactattacagtatcatagcagataaaacgtttaagttaataaaacaatcaaatgttaaattttgaattagaaaggattattttgataattgtgctagctgtgctgagttggttcctaaaaaatcgagagcacttcagctgatagtataaattgggcatatgcattttgagaaatttgattagaaatataagcttaaatgaagatatttgcaaaaattgctctttcatgtttttaaagtgtaatattaaagaattctaatagagaaaagaaatgccagtgtttaagctttccacatacttttgggatccagtaagtttgttcgaccttttgatatttttttgactgt

SEQ ID NO: 20359 - DNA, 3440 bp, Homo sapiens
cagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactga

SEQ ID NO: 20360 - DNA, 1644 bp, Homo sapiens
  misc_feature (72)..(72): n is a, c, g, or t
gggtataaccaattggtatgatgaacgctgcaagaatccttctgtaatactggatgactcactgctagtacntgaggagaaatcctatggttctggtgacatatgttccttggaattcatccacgcccataaaatgcacagcccagtagggcagggcgtgactgcttctctgaaattaataatccaggtgtcatctacggtagtgctctgttactgtcatcttatcccatctatgatgtcctacgtcggatctgtgattcaattagaggcactagtcctgtcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactga

SEQ ID NO: 20361 - DNA, 492 bp, Homo sapiens
gctcaggtcacctggcaagttagaggtcatgctgggacctgaacttgtctcccacatattcgtcctttgtccttcccttcatagctgcctgatgtgggttgtaatttaccccctgacttccctttaataagctccctccttccttaaggatcgcacaccccagggcagttggattcattccatgcacactgttttctcagtcgttcatccttgctcaggcccaaacttaacttacagagcagtcagggaaaccaggaactgtctttccactctgtggacctccaatgtggcggttacctgcagctccaccatctgctacgttgggataaaatgttctccccccagtaatgagtttgctcccagggcggtgctttgaaaacactcagagatcttcaaatgggaaagcaggatttcagagggcaaattagctggccctggcccgaacaatgagctctccactcacagaccacctcttgtcaattccattaatct

SEQ ID NO: 20362 - DNA, 803 bp, Homo sapiens
caggaatccaggagaaacttaactggatagttttggcatagggcctctcaaaaggatgctttttaaggaataaaggtaatatgcatacttgaggatcacattaacgtggcacagcttttcttaaagagtgttaaagagaagaatgcagaagtggcaaagaattgcagcaagtatctgagattctactggggctcaaaaatctgctttcaggctcacctaatggttgttggtaagcctcagttcttcaccacgtgggtctctccgtagggttggtaggcatggcagctgtctttccccaaagcagttaatctaagagagaaaaggggagcgagagcccaggatggaagccatagtatcatgtataacctaatctcaagtaacatatcatttctaatggtcacacagaccaaccctgttgcaatgtggaaagggactatatgagtgtgtgaataccagattggggtccatcttgcaggctggtaccacagttgcacagctagtaagctgcataactaaggttaaaattcatgtctgaccccggaggctgttctcttaatcatgtctgtgataagtgatggaggaaagatttgtgtagagtgactatgctgactggagcattagagaagatatcggaaggttgcatttgacctgagtctgcaaaacctcggagttcgcgggggggacgggaggctacactagggacccccgtttgtctgggggcgacagggtctggcacaacaaccccgcgcagtaaaacaaccggcaaacatcccacccggcaccggcggacacacccccccgct

SEQ ID NO: 20363 - DNA, 921 bp, Homo sapiens
caggaatccaggagaaacttaactggatagttttggcatagggcctctcaaaaggatgctttttaaggaataaaggtaatatgcatacttgaggatcacattaacgtggcacagcttttcttaaagagtgttaaagagaagaatgcagaagtggcaaagaattgcagcaagtatctgagattctactggggctcaaaaatctgctttcaggctcacctaatggttgttggtaagcctcagttcttcaccacgtgggtctctccgtagggttggtaggcatggcagctgtctttccccaaagcagttaatctaagagagaaaaggggagcgagagcccaggatggaagccatagtatcatgtataacctaatctcaagtaacatatcatttctaatggtcacacagaccaaccctgttgcaatgtggaaagggactatatgagtgtgtgaataccagattggggtccatcttgcaggctggtaccacagttgcacagctagtaagctgcataactaaggttaaaattcatgtctgaccccggaggctgttctcttaatcatgtctgtgataagtgatggaggaaagatttgtgtagagtgactatgctgactggagcattagagaagatatcggaaggttgcatttgacctgagtcatgaagaaacactagggattttctgtgtggaggagtcagggaaggacataccacgtaggggaccagcatgtttaggtgcttggaggctagaaaatgtggtatgtttggagaatagagcataattccaggtggttagagtgtagagtgcatggagggaggataagagagtagaaaaaaagcttgcccaagattaagtggatgatgaggaacagttgaaggtggggctgatatgataagattgtatgttcattactgtaaagttacag

SEQ ID NO: 20364 - DNA, 461 bp, Homo sapiens
gcccacctcggcctcccaaagtgctgggattacaggcgtgagccgccgtacccagccacctttgttattaatgaaaagcttttccccttctaatttcttatctgtggattgataatagtgccattcatttcactttgagaaatacgcagaactcattgtccagtggtcactgctttgttagagtataagttattggcctcaatagtttgttctctggtctcctcagttaaaaaggacttttttatgggtctaagacaggctaaaggtagtatgtggactttaatagatacatatatccaacgggcaatatttgacactaggcaagctgaagaaagtgtgaattttgaatatcttatgttttgtggaaggtgagggatgagtgcttcccccccacacacatatcaattagttatttttgacaaagttagtgttagtgtcatctggaagctacagaaattatt

SEQ ID NO: 20365 - DNA, 404 bp, Homo sapiens
tcctgcttcacactgccccaggtccatgactcattctccttccagccacgacccagaggccacaagtctgctccagcccctggtggcttggtgaggacatgttcacatactcagtgccaaaaccggctctgggcctagtaacgatttttttctttagtttggaattgcgttggtgtgaaaacattcacaaatgtgtaaagatcaactcagttacacaggacctactgtgcagaccctcgcgtcctgttgccatagcaacacctacctggttcctaccctcccaaccctgggaggccacttgcagctctcatcccagtaacagagcaggaacctggcgtggggtgggggtgcgtgattccccaggtgctggccagaggggtcccgcaggcaggctgggctcccag

SEQ ID NO: 20366 - DNA, 594 bp, Homo sapiens
agacagtggagaaggcagcctcccaaagcactcaggttcccaccatcactgaaggggttgccgcagccttgttgctcttaaagttgtcagtggctgactcacaggctggtatgagtccagaggtgtctaggatggtagagacaggggcctctgacaagagtccttgggaggtgtgtcttgatgttcaggattagcttggtcctgaccacactggatcagccacaggtttgcttgtcatctgcaggatgaacctcatggttgcatgggcagtgggaatgcagtcaggggactgtgtcactgtcctccttcattctgttgctccagtgctacacaggcttgtagatgatacctagatggaccagggtttagtattgggactgtttgtttcagttggttatacattcatacagtacaaaattcaaaaggatataacatgagaagcttccccttagccctgtcttttcccgtagccgttaagtttccctctgtaaacggtgttaccaattttgcactttgggaggccgaggcaggcggatcacgaagtcaagatttcgagaccattctggccaacatggtgaaaccccgtctttacta

SEQ ID NO: 20367 - DNA, 418 bp, Homo sapiens
ctcaaacatcaagttctacatccagaactgcccctcaaccctcaccctctcgaactcagtaaaaaacaaccctctttctagctctgcatttccaatgaatgcctcttcctccagacatccctagtttttgttcatgatactaggacattcctaaactggaaatgtgagaatcatgtggactgctcgctccctccttcattgcctgagtttaagcaaataatattgattagttttccccaatattttctgtaatcaactatttcgtttttgtttctacaatgagcagtcttgttcatgcacctgttactctcacttcaaccattcagaaagattcttagctcccatttactcatgagttcatttgatgcatatttgagcatctgttgtgtgctggaggcactatgctaggtgttgagga

SEQ ID NO: 20368 - DNA, 395 bp, Homo sapiens
ccaccctttatagcagttacctgttaccaacctggacagcctgagacaacatgaataagattccatcaattctcagatgcttttcggctagccatactctcaagaaaaatgtgtgtgcttttcttagcacggaacaccagcaaaaagactacatccatctcctgccaactggattgattcatttatgacaagaacttagaattcgaacattacccccgattgttttggaaattattaaaagattgtcaatggaaagatttacaaaaacactggagaaaatgaggggctaacacactgcaattctagtgacagagcccctcatgttaaagagtgaccctcccattatgtaaacattgttggaaaacaattataaaacaggatgcattgtataagct

SEQ ID NO: 20369 - DNA, 381 bp, Homo sapiens
aagcgcggggccactctggccgcgcgcctgggggctgctaggaatcccataactttgtctagctaggaaaaaatgaacaagtccgagcctcagcgcgcagactcagcgactggtgcccgcggctccgcaaccgcgagccaaggggctgggtggcgggcagaaccgccttctcccggcttcggccctgcgtcccctgtgctaggcgcgtgactttccctgggccttggggagcgcacagacagcccgccagccgcatcttctcctgacatgtcgtgcctttcttttcgcggacctggagctcagagctcccacggacagaagaatccagccctggggaagggccgcgtccaagtgctaagcagctcatacttctcccccacc

SEQ ID NO: 20370 - DNA, 913 bp, Homo sapiens
ttttttttttggctcatcagcgatcattagtgttagtgtattttatgtgtggcccaaggcaattcttcttccaatgtgacccagggaagccaaaagattggacacccctggcttagactaacactcattatgatgatttcccataggatgatacataatcaccaccatcctgtgggtcattaacaatgacctcacacttctgtatatgtaaaagggatatgaatattccttctacctacatcctaggagagttgtgaagacaaatgaataacttatgtgaaaagctatctaaatctgtggtactatatttgccagatggtacaagaggtgattttatggttgctccccgcttcaagtgaatatataattttagatggtttgacaaacctgaaatgctctagacgttgaaccatggtagtgcaattgcaaatgtttacagactgtctcattaacccctctgtgtcttcattcctagtctagaatactctgtcttctctatcagggctctgatcaagttgcacaacttgattttctgagagatttaatgcagtctttggtagttcttaagctgtgagatcattatcactgcatgttctcaagcagagactagatgttcatctgtcagaggatgtcacagaaggatcctgtgtttggtagtttagcccaaataatctcctaggtccaatccagttctaagacttcgtgatttctcttcagcctttcctgatactctcctcctctgaataataatcataataacaatgatggcaataatgatacctactaatttttgagtgcctagaatgtgccaggcactgggagcacaatgatctattaaattattggaagaatcctgcaaagtagatattatttcacagataaggaaaagaagacacagagtagtccagttttc

SEQ ID NO: 20371 - DNA, 306 bp, Homo sapiens
ggggtggagacacgcatcacatgactctcagatgattcttggcaataagaagacaaagattttcatgttgggagcttaaacactgaagaatttgcaggtatctttttaaagcattcttgtgattcttctttaaatcaatggttctcaaccctggctgcctgctacaaccatgtgggagcttttgaaacataccagtgcagagactgttccccattgtaattctgatttaatcagtctagggttttagagtgaggagctcttcaggagatgcaaatgtgcagacagggcgttgaatcatttcaggtc

SEQ ID NO: 20372 - DNA, 1702 bp, Homo sapiens
gtccaaaacaaacaatttgggaacatgtgaaaggagaccttaggtctgttaaggaagaggatgacactacgtgacaacttccgattccagaaacagtctggacttcagggattatatctggggggataaaaagcgcatgcaagtcttcaccgttttcaggaaaatcaaattggccagtagcaactgtcctcctgccaactaatgaaaggtcttcttatttattagcagtgattagataaagcagttaaaccacattccaatcaattttggttgctttttttgcatccaacatttggaatgcaactccttatgtaatttctggtatcctatgttcaatgaaaggtggagttacttttttcccctcagaatttaaagaaagcaatatatttatagggagctcttctttgggcttcccaaatcctggttattattgggcttgatactccttcagtctccgcctcctcctgttgggtaggctcaattaaaaccttttgaatttatttacttttgtttctgattaggattaataggctctaattttgtgcctggcttttgctcttccaaatgctgtctcaattggaaatgaatgatctcttgacaacgtaatacttgtcgctcaaagccctctgactctcaggagaaacgttttgtatctggacactgtgcgctgattagcagttttaagaggactgagttagaccaggcgatgagaaggatctctgatttaagcgaattccccttccccagtccttctcacacacaactcctcttccccatttccgatggtatgtgcagttcccgggtcccccttgatgtttaggttctgtgtctgtttgacactagtaggtagagtcagtggggagacctgtggacgggaggggaagggtgtgaacaggcattcagagtggcagggagacacactctactcatgctgctgttgctcccatgggcccccattgagagcagcctcttgtccttacagaccttggaaactggaagaaggggcatagaggttccccatgagtttacgttatctgttaggatgaacactggcactggaagcgtgatgccatgtggtttaacagaaatgccatctctctaatggtgaatttagttacaggtggtcctctagttgcagagtattaactgtgttcctacagttttttaaaaaaaatcttgaacagatccaaattggcacttttgctctttttagcgattttaactgtggagaaaatgggttaattttgtgattctgttgcagagcttcagccacaagtgtgctccatggaggatgatgaatatttcattttctgtatatacccaagtccccactgtatgcttagggatccccccagttattacttaacatcttttattttcttcattcaaacatagcttctaaccaaaccatcataaattcattttcgtttcttgatctctgcgtgtgttttttcaagagttcccaaaagtcctcactagcaggttgttaaggatctttctctgtgtcagtgttatgttaactgatgactgtaggaataaatgtgtgcgccgggattttattagctgctatttgcagcatcttttttatatcagctctgtgggagcgtatgtgtgtatatgtgtgtgtgtttgctctccatggttgttgcttcaactaggcaatttgacatttcaagaaaacaagaggcccatcctagtatga

SEQ ID NO: 20373 - DNA, 468 bp, Homo sapiens
ctccatagaacagactttacgttctcctcaggcaagcatgatcagtgtctggagccagcaaagctttgagggagggggagaagcttcaggggcatggaacgttttataaaatttcagttatttggttgggagaactttcaggcaacaaccttttaagcaacaaaacttgtctcaaatttcttttttaaaaatgggatcttgctaaataaaatattgatacattttcctattttggttaacagagtttactaagtcttatcaaaccttttactgccctttcattattatcaccgaagtcagttattctattgtgccagtggatatgaaaggtgtgtatctatggcagggttcttaatctttttctgtgtcatagatgtcttaatgggctggggtagcctgtggactcctcagcataatatttttaaatgcatagaataatagaattacaaagaaaatcaattatattga

SEQ ID NO: 20374 - DNA, 118 bp, Homo sapiens
ggaaatgggcagaggttgtgcaggtgccagaagactgagctgggctgaaagaaaaggaatgaaggaggatggtggtcacaagggagtctctgcacagtgaggaccaccccctactcag

SEQ ID NO: 20375 - DNA, 969 bp, Homo sapiens
tctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcatactaccttgta

SEQ ID NO: 20376 - DNA, 491 bp, Homo sapiens
gtctatttctttgtctctctcactgagagttaccatagaacagcaactctggaaatccatgttgattggaatagggtggcccaggcagcagtagttcagatagctcttggctaccatggtttttctacatgtgccgcttctggatgtgcattcctaaacatttaaactctcaaagctaagatagtaactaccagagcactgtaataattaaccaactaacctccctgtcttcaaaaagatgctgtgagttagattcagtgattttgctgctgcttgtatttttgttttagcctgttttagtttttgtttcaaatcatgatgcttttattttttcatttttgatgtgtaagtttgcaattacgcctttttgggttgctgctgaaaccaagaattctaaaatgtcatgcacccaataagaaaaagtgaaaagaaatagctcacatgaaggattttctgaaaacagggacttgtattaattaggagttctaaaa

SEQ ID NO: 20377 - DNA, 434 bp, Homo sapiens
ggtcaggttttaggatagaaactgcttaagagtttatgtggagcttaaagtggtattaccttgggatatgctgcagcagcaagtctgtgacctccagtgagatgctgtttacatttaacaagagatgtttgctcacaataaactttaaagtgtgtcaggaatggaccttttagcgggtgttcaggcaattggtttccctctcttcgtctcaagacgtcaatgtacttatgtgagaatctttgatggggtctttcagtctctttaacccagactgcttgcctgcatcctagcccctatcagaaagaatttaaggaaaaggttaggggagaaataggatctgataacaacattagaattttctaataacctggaacccacagaaggatagaattaatagcatggatttaaaaaatctggtttaaattgttcccttt

SEQ ID NO: 20378 - DNA, 325 bp, Homo sapiens
tatttttagtagagacagggttttgccatgttagccagtctggtctcgaactcctgacctcaggtgatccatctgccttggcctcccaaagtgctgggattacaggcgtgagccaccgttcccggcccatccttgattcttatctttctcacactacacccaatccatcagcaaattgtcagtttcaccttcaaaatattgcttgaatccaatcactttcaccacttccgttgctatctacatttccaagccaccattatttcttcagtctattgcagtggtacccaggtggtcttcccaattccatgcttgccccatagtctct

SEQ ID NO: 20379 - DNA, 714 bp, Homo sapiens
ctccagatctccaagggcttctctgcattccagtggccacaaaaatatttttcttaattgatttgaactcatagtggcacaaaaaaatgaaaaacaagtttcgtcaatggtcagaagatgagaaagaaagtaaatcagtgatgtagggagtaatatgagcaactttccaacctactaatgcaacctatcaatttgaccaaactcatgtcttaagacccagatgcaaagaaaagatgtatcttagatgacagaagataacagaatcctcaagacaaaaacaaagtacaatcagatgtcctgtcattgttgcctcacaaagaacggatcgaccattaaaatgtgtattttcaacattgctgccaccaaaggagaaataagtggctgtttacaaatcagaaccagtgtcaaacgcagacttggccaggaagcaaaaaacatatgaagagccagaaaaagaacttgaatcaactagatgaagactttattgcctcaagactggaaaatgtatacctcgaacagcccttgagttgctcttcatggacaatgtggtggactttaccctggttgatgcatacacaaaatcttagaggaatctacacaattgtcaaagaaatatagacaaaggatttaggggggaaagtttactttcaaggaaagtttgcaagcaactcccaagttttaaaagaactggctcatcaaataaaaaaatacaaa

SEQ ID NO: 20380 - DNA, 4473 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatctttgtgcttgagttcctgcctaaggcaataacattattcttttgacaacttttgcaggggaaattatatcaggcaaccattttgattaagtaaataaattttataggcaaacatagagagagaaatacaatttgtagtatatcaatgactatatttaaaataaggaatataattgttatcagttatctaacttaaaatgcttatccataatgatcagtgatattcagctttttaaaatatgcttgttggttgcatgtctgtcttcaaaac

SEQ ID NO: 20381 - DNA, 3340 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatattttttaaaccatgtatacagctcaacagcaagattaataagttataatacacacatatca

SEQ ID NO: 20382 - DNA, 583 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtacggccgctgggctggga

SEQ ID NO: 20383 - DNA, 264 bp, Homo sapiens
cagatgtaaactgcagaagtggttggtgtggaggcagtgaagggctggtcaagtggaggtgtatgtagaactaagagaccaagggggccctgaggccacagccctgccccaggggatgcacacagattcacctaaagccctttccaaactggaggatgggcgttttctttctggtatttgctgcaaaagagggtccccagtgatcatccattctttttcaggcagaacatctcaccagctgctactggggcgggagcagcaacg

SEQ ID NO: 20384 - DNA, 4183 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaata

SEQ ID NO: 20385 - DNA, 4419 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatctttgtgcttgagttcctgcctaaggcaataacattattcttttgacaacttttgcaggggaaattatatcaggcaaccattttgattaagtaaataaattttataggcaaacatagagagagaaatacaatttgtagtatatcaatgactatatttaaaataaggaatataattgttatcagttatctaacttaaaatgcttatccataatgatcagtgatattcagctttttaaaatatgcttgttggttgcatgtctgtcttcaaaac

SEQ ID NO: 20386 - DNA, 481 bp, Homo sapiens
cacttagcatagtgcctggcttgtaataagaactcagtgaatgctattatacattattcttgctactgttttaataaaatcatgcaatcagatatataatgtatctccagtccactcatagtgggagacccaagatagttgcttaatattctatcacatgtctaaaaagtaactgtttctggaatatgtgtatgaagcattacagtttaggtctcaagtacaaaaacactgcttacaataaccttccatgatctaaaaaggactcgggttgttgacatcaaaggagtcagatgtaggacgcccagcaccagagcatgagtggatgtcagcatacggtatgcaaggtcagctagcttagtcacagacttcactttctggcagtcttctgcctattttttggctgcaaggcaagtgtttacttctccttctatgaacagatgatttccatagctctggggtttgaaaaggtcagcagtgataa

SEQ ID NO: 20387 - DNA, 403 bp, Homo sapiens
gcttttacatttgtattttcaaatgtatatattctagggaaggaggaacctttcaggtccccagtggctgattttcacctttgatctgaatactagtattcatagcatgctactgagttgactttttgtatttctatataataacagtgtatcgatctcttgctaatctgatgtaacctttgtgtgtgtatatgtatgtatgtgtgtgtgtgttactgatcaagttaaattactccagaggccaaaatcagaaactagggagggtgaatatttcatcatttaaaattgagcttatattgttattaatgcaatgttaagaggacagcttttcagatactgggttatttaagcagcttcaatgtacatcatcccggaagggatttggagatctccatctttcttc

SEQ ID NO: 20388 - DNA, 378 bp, Homo sapiens
gaaggcagaggttgcagtgagccgaggatcggccactgcactccagcctgagtgacagagcgagactctgtctcaaaaaaaaaaaaaaaaaaaaaaaaaaactaataaaataaaatggatgcttgtacttttctgctctgttaacctttctaaatttttttttaaatatggcactgcaaagattctatgactgaggtaagatcagatttagctctgtgatttggagactgcatctgtttctttcaccatctctccaactctccacctcttctcttctttcatcttttcattccaaggctcacccagtgcccctccctctctgagatcctgttttcatacggctcccttaatgttcatgtccctccctgaaatctgtat

SEQ ID NO: 20389 - DNA, 492 bp, Homo sapiens
atgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaa

SEQ ID NO: 20390 - DNA, 171 bp, Homo sapiens
ggaaagataccgtccacacattaattctagttcctttgtaaatctcttcataaccacatattaagaatagtatgattagctgagtaaatcatgattagtaagatgacacttggttagaaaggagatagaacggtcatttagtaaatgggtcaatgtttttctttataattc

SEQ ID NO: 20391 - DNA, 473 bp, Homo sapiens
ctctggagcccaactgcttagttcaaatccacctcccctacttactagctgtatgacctcggacaagttagttgacttctctgtgccttcatttccccatctgtacaacaaatgacagtacctatctcataggattactatgagaattcaatgagtgctcagaactgtccctgttacctagtcagagctccataaataggcaggttgttgttatcctcctccaaagtccatgcttttgctccatgagatggctttgtcgcccaatctctactgagagattaagaatatgctgcacattaaaatatacaggtttctttttactgcagtaatgctaaatgcttagatgaaggaagagatcaaaggtagtccaaattcacctacattacaattctccctgacgttctcagggcagtgacgctaagccaagagaatgagctccatttagacctctcttccttccaccggcatcttcc

SEQ ID NO: 20392 - DNA, 247 bp, Homo sapiens
taagatacttgtgtactgcaaattggcaagaatttaaaagaatgctatgaatcgatgtgaataaggatatgggaaaacagacatgcatatgccggcagtgggggtgtaaattgcacaaatatatttctaaaaccatgcaaatttgcctttactttatcccagctgttttatgtctaggaatatattctgtgaaattacaggcatgcagaaagactacagacatgcaacatcattcatgatagttttc

SEQ ID NO: 20393 - DNA, 792 bp, Homo sapiens
gaacctcgaggagttagaggctgtagtgagctataatcacaccactgcactctagcctggtggaagagcaagaccctatctctttcaaaaaagaaaaagattcatatcgtatgtgactcagggttgggtgactcaggtctgtgactttgcttgtagaaattccatacaggagctctctctgttgttctgacattgtgttatgggttactttgggcatgcctgtgttttaagacttgttcacatgattatagaaggtctaatcataaaccccagaggaaattggcattgtggtcatggttattaacaagtgaggtcaggcttgccctgtgaatttgctgcaccaggcatgtggagctaacatctgcagagtggccaccgcctttttggcatcggttctgctgaaaagtcacaggcctcttggatttgacaatgttatggctctgctcggattgtctgggatagaaacaaatactcatagatcctcctgcttcccacgggacttaacgaaccttcgtttatgggctggtatgctttcccctagacaaatagcacctcattctatttgagtgtaaactagtcggaaaacgtttagggtggagatattgcgtcttttatgggatccacccatgcactgtttgaattccctgattcccaccactcagcgtaaacagctccttttttcatgaactgaggttcaaaaagcagttggcaagtcgtcttttcctatgctgagaaaagggactgttgtgtttaaaaaatagaagtgaacaaagcaaaaacaaaacaaaacaa

SEQ ID NO: 20394 - DNA, 927 bp, Homo sapiens
tagacagatattgtgtaacaagttaaccttaaggacacatgccttaaaggactattgagcaaaaaaaaataactaagctctttccaggtaacactcagggaacttttgcagtgtcatatccgttctctggtacctatgtgtccgatcttcctgcccatctgtttttttcactcaaagtcccagaatcctatgccacgggcagggattttcacctctcaatatagacccatgtaccttaccccatgttccaactgacttcctgagaaataaatcattgtccttgtatttcataagagacaacaaacattgattttgttgttaacatatgtgaggcttcgttcatccaataactatatattttaatcaccaataagtatcctaaaatttcagacgctaatgccctgagggatcaacttttaatcaattattgactacagtttgaggggtgccatgtccagattaaatgcagtatgatttatcctatgggctacgcagcttgctcctggcacgggcaccttgaatctcctcctcacacagatggagaccatgcttgatttcctgaacttgtagtaagaagaaggaaaacacagcacgctggagccaacaggtaggcgagaaaccaggtaggcgagaaacacgtttctcagttatgcagcccagcgtcgaggaaaaataacagcaactctacaaaatcagaaatcagcgtctaaggactaatgagcagagagaaaagtctaggtttttttctttattaatgtttacctgctatagtatgcaaaatatccttgccataaaagccttatttcttttttaaaatttttaattgtattttaagttccaggatacatgtgtaggacgtgcaggaaaaagcctttattctgaaagatacaggagaaaaaaactcatagcttaaaagagtgtcttttt

SEQ ID NO: 20395 - DNA, 2653 bp, Homo sapiens
tagacagatattgtgtaacaagttaaccttaaggacacatgccttaaaggactattgagcaaaaaaaaataactaagctctttccaggtaacactcagggaacttttgcagtgtcatatccgttctctggtacctatgtgtccgatcttcctgcccatctgtttttttcactcaaagtcccagaatcctatgccacgggcagggattttcacctctcaatatagacccatgtaccttaccccatgttccaactgacttcctgagaaataaatcattgtccttgtatttcataagagacaacaaacattgattttgttgttaacatatgtgaggcttcgttcatccaataactatatattttaatcaccaataagtatcctaaaatttcagacgctaatgccctgagggatcaacttttaatcaattattgactacagtttgaggggtgccatgtccagattaaatgcagtatgatttatcctatgggctacgcagcttgctcctggcacgggcaccttgaatctcctcctcacacagatggagaccatgcttgatttcctgaacttgtagtaagaagaaggaaaacacagcacgctggagccaacagagttaagaggaagatttatgagtcatggaaccctccatcagatttggaagaaagtagaatgagcgcagaggtgacagacagccactgaggcccatggacaatctccacctcacgcttctctatcaaacttgaagatttattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaaatggtatatgcccagggatttgtacccagacagtaactacccacctttctgttcggggactggctacatcttttcagccgatgtagctgaactcatttacaagacctcactccacacaaggctgcttcaccttgaagacgtatatgtgggactgtgtcttcgaaagctgggcatacatcctttccagaacagtggcttcaatcactggaaaatggcctacagtttgtgtaggtatcgccgagttatcactgtgcatcagatctctccagaagaaatgcacagaatctggaatgacatgtcaagcaagaaacatctcagatgttaggatttttaccaatgtaaatatgtttcttttctttttttaagaaatgggacctaaggtgttggtattttccaggtgtcgggggaaatgaactggtgaaggggttttgtaaagtttttgcttcctgctataagttcttttcttggattaccaatttatgaatgttagactctggtcatagaaacaataaatgagttagaagggccagatttcattctcagtcccagagcattgctatttatctcaaaaagtgacttccaaacaactcttaggattgacgtaccgtgcatctgagataaaaatttggttctgggaaactgaaactcacagtaatgtgtcatatcatccctgcaaaaattaatacacaaatagaaaccattttcaaaagcaattcagaaaggatgcacagtcaggaagacacactggatgtgattattaatatcgtgtgtgttgttacattatatttttacatatattcccatgtaatgtgtacagtctttgcagttccaccaagaaatgaacttggtacctgcagagtggctgcagttaaatagatgggagtttaaatttgagaatcaaacattctatgtgtttggaagacaactctgcttgctcatccaaggattaaatctggtcagcaggtggaatgtgtataaaatgctacttaacaaagtaaacaaaagattttttttttctttttttttctttcttttttgttttgctctttcagaacaaacattaaatggtgcctccaaggaaactttgccaaatataatctcacctgcttccttccagacagtgtcgctaagtgcatttcacagtttttggatctggcaggc

SEQ ID NO: 20396 - DNA, 367 bp, Homo sapiens
ggccccgcagtgctgataggagcttttcctctcgctttgcctggtccaccctgcccctgtctgagggtgacctggccccatggctgcctgcactctcctccctgatgtgtgcaatcctgcccggcctgtgcctcgtcctcagggaggccatccgggaggccacagctggcctggaagtgtgcttgtctgtctctacctcagggctgcttgtgcacctcctgtacctagaggtgatccaggctcactgagaatctgcccacactgttccacacgtttaggccaggtgcaggggctcacaccagaaatcccggtgctttgggagactgcagtgggaggattgcttgaggccaggagttcaagaccagtc

SEQ ID NO: 20397 - DNA, 343 bp, Homo sapiens
tttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatc

SEQ ID NO: 20398 - DNA, 766 bp, Homo sapiens
ggagacagagtcttactctgttgcccaggctggagtgtgatggcatgatcttggctcactgcagcctttgtctccaggttcaagtgattctcatgcctcagccttctgagtagttgggattacaggggtgtgccaccacacctggctaatttttgtgtttttagtagagatagggtttcatcgtgttggccaagctggtctcgaacccctgacctcaggtgatctacccacctcggcctcccaaagtgctgggattacaggcgtgacccactgtgcctggccagttttgaattttttaacttaaaaaaattgcaacttttataatattttatgttttataatgaaaaaatgtaatcctattgaatgttcctctgagcatagctttagctatattacttaaattttgatgagtaatatttttatgtttatatatttaaaaacccctgcagttgcagtttttattttttcaacaagtatttaagcacctgctccatctagacattctgccaagtgctgaggacacaactatgtacaagacaaggtctcttgccttcatccagttacagtctgtcaatatagacaaaccaacgaataaagaattttcagatttcgacaagtgtctaggaagtaaataaataatagaaggtgctaattggatgatctgagactgtctctctgaggatgtcatgtttaagttgattggtggtaccaaggtgtgtatgggagtttctttagctttcccaatctatcgaaacataaaaaaaaa

SEQ ID NO: 20399 - DNA, 411 bp, Homo sapiens
ttgtgtttggtatgaagaaatggaaagcagagaagcttggagatttaccaggactgaatttcttcacagtcaacaattggctcttaaacttgcaaaatatttggagcatgtgtttttctttgcttgttagttttcccacactacagtttttctagattttgctaatccaagtgcctggctcatttttccctcagcatccttatgcatttcctccccagatcaaattccctgcctaaattagtacacatttttgttcttgaagaaagaaccgaatcagaaagagaatcaaaatagaccattattgtcctggcatgaagacaagcaattattgtattcttcattgcagttttttcacttaaaatcatcccagagtcgtataagagatttaataaaaatcatttatcatgaaaa

SEQ ID NO: 20400 - DNA, 365 bp, Homo sapiens
ttttttttttttcgtatttttagtagagacggggtttcaccatgttggccaggctggtcttgaactcctgacctcaagtggtctgcccgccttggcctcctgaagtgctgggattaaaggcatgagccaccacgcctggcccattattcttcttttactagcagtttctagtgtccattaactaatattttcacctttgtcgttgttgagacagggtcttgctctgttgcccaggctggagtacagtgacgtgatcactgctcactgcagcctccatctctcaggctcaagccatcctcccacatcggcctcacaaagtagttcagaccacaggcatgccctaccacacccaggtaatttttgta

SEQ ID NO: 20401 - DNA, 406 bp, Homo sapiens
cacatgttctagggggcttagtggcattcaaagctttgtctatggaaaagggtgcctatgaatcttggtgcttccagcttttttcattggctgggagaaggcctgtgttgtcttctcagacacagggcatctcttgaacttggaacagacaggagtctgtaaagaagggaagtgtgttgaaaggagggcaaaatactgactttgggagtcaaaaggggatgcagtgtagaaagatagtcacaatatattgtgatcatatcaaagcaatatgtgtggaatcccatttttagtgaagagttgactacaaaaaattcatagaaagtatctaggatgtgaagttacaggtgatgtttgcttctgtttgtattttctaatctttctatagttaataggtatttcttgcata

SEQ ID NO: 20402 - DNA, 621 bp, Homo sapiens
gagagacaactcactaaatgcttgtgtgtcaggttcagtgttggggagctgggaaggtgaagaagaatgagccttccaagagattgtgctctgaaggaaatatgtagtataagttatgttcatttatttagtaaatgtttaatgaatgcttcctctgtgttggacattcatcagtgcttcccaacaggacactattggcattttgggtggacagttctttggtgtgtgggaatggcccacgtgttgcagaacctttggcatacttgcccattatattctagtagtagtctcagtcatgcgacatcaaaaaattgtaactcccattccctgtgcatacttccaaatgcttctaattgaaaaccactgctctagatactgttatgggtatttaaaaacatgcgaatgtttgattttagatagtttccacaaagggtttaaagcctcattaaaacttgtcatccttaccacttccatccacctcctccacttcctcatcatcacaatcacagttcatagttacatggcttacatcacatgttccaactaactgttttatttgatcattccagcaatctagtgcggtattattcccattcttactgactagtggagataaaaaaa

SEQ ID NO: 20403 - DNA, 281 bp, Homo sapiens
tctcactccatgcaattgggtccttcctgggcacagatgccagttttatcttcctatgctgctctatgcagcagaaatattatctgatgctttttttttgtttcttatgaaatccattctaaatatttttgtagggttttcaaggcttctcaaatctgtaaagccttgatcaaccccaattttattcctcactatactgtaggaaataaaaccaaataaaactgaatctggactgttgtcttatgcatcactaagtacattatttctacataaaaaaaaaa

SEQ ID NO: 20404 - DNA, 531 bp, Homo sapiens
tggtatctctattttacagaagagatcgaggtctaagcaggttgtcatttgctcaagctcatacagttggtatgtggtagaaccatagtctgacttcagaatctaggatgaacctaattcaatcaaaatatccttctgttttggcattgcattactaaattgtatagctggaaggcagctatactagtgttttactgtatatctctattccagtaatttcatctctacttaattgttatcatctgttaagtgggattgtttatctgcacttgatagtaaaatacggtctacttaggcttggatgaaaaaatctttagtgaactttacctatcatctataggatcatgttgttctgctaaaaaaaaaaaaactcccagttaagcctcaaaacttaagatttttagttcatggccacgtatgatggttcaagcatgtaatcccagcactttgagaggcctaggtgggtagattgcatgagcccaggagtttgagaccagcatggggaacatggagaaaccccatctctaaaat

SEQ ID NO: 20405 - DNA, 749 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgtgcagctgatcaagactggagacttctttggggtggtcaccaacaaggggttcgcaatggaggatttacaaccctgagtggttggtattacaaaggaactctgcttcttcgttcttgagggggggcgcaatgttgccggggttgttttaatttggtacccaaccgtggcttagaccccttctctttaacaggggaaacaaatcttg

SEQ ID NO: 20406 - DNA, 518 bp, Homo sapiens
  misc_feature (493)..(493): n is a, c, g, or t
  misc_feature (516)..(516): n is a, c, g, or t
gcctgagctccctgcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagctccttttccagcttagnataccctttccagggactgtctntg

SEQ ID NO: 20407 - DNA, 1571 bp, Homo sapiens
  misc_feature (1169)..(1169): n is a, c, g, or t
  misc_feature (1173)..(1173): n is a, c, g, or t
  misc_feature (1175)..(1175): n is a, c, g, or t
  misc_feature (1179)..(1179): n is a, c, g, or t
  misc_feature (1185)..(1186): n is a, c, g, or t
  misc_feature (1189)..(1189): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20408 - DNA, 1573 bp, Homo sapiens
  misc_feature (1155)..(1155): n is a, c, g, or t
  misc_feature (1514)..(1514): n is a, c, g, or t
  misc_feature (1548)..(1548): n is a, c, g, or t
  misc_feature (1564)..(1564): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaactttttcgcaacgggtttgccgccanaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctnagctgactgggctgtcctgattggtgctgctggngttggtgaatttgaanctggtatct

SEQ ID NO: 20409 - DNA, 1581 bp, Homo sapiens
  misc_feature (1179)..(1179): n is a, c, g, or t
  misc_feature (1183)..(1183): n is a, c, g, or t
  misc_feature (1185)..(1185): n is a, c, g, or t
  misc_feature (1189)..(1189): n is a, c, g, or t
  misc_feature (1195)..(1196): n is a, c, g, or t
  misc_feature (1199)..(1199): n is a, c, g, or t
tcccccgggctgcaggattcggcacgagctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20410 - DNA, 1094 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtgatcgcgcaggcaccataacacctctgaaagctacgaccaggtccagcttgatccatggctcttagtgtcggctgcccgtatgtattttgcccccccacctgctcttgtggttcctgcagccccagttaaggttcaaagcaagaaagagtattaccacccctcacaccgcatctggtcccgttcctgcccccgccctacctccgccccaccccatcatctgtggactctggagtctggaataaatgctgtttgtctcatc

SEQ ID NO: 20411 - DNA, 1385 bp, Homo sapiens
  misc_feature (983)..(983): n is a, c, g, or t
  misc_feature (987)..(987): n is a, c, g, or t
  misc_feature (989)..(989): n is a, c, g, or t
  misc_feature (993)..(993): n is a, c, g, or t
  misc_feature (999)..(1000): n is a, c, g, or t
  misc_feature (1003)..(1003): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20412 - DNA, 808 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagcaggggctggcctggcagattggcttatcccaactggtctgcataaggtccccccattctatttattcgggtacccggcct

SEQ ID NO: 20413 - DNA, 1515 bp, Homo sapiens
  misc_feature (1113)..(1113): n is a, c, g, or t
  misc_feature (1117)..(1117): n is a, c, g, or t
  misc_feature (1119)..(1119): n is a, c, g, or t
  misc_feature (1123)..(1123): n is a, c, g, or t
  misc_feature (1129)..(1130): n is a, c, g, or t
  misc_feature (1133)..(1133): n is a, c, g, or t
tctctcgccaggcgtttttttggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20414 - DNA, 789 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgtgaactgatcagacggagacgtgggagcaggaagcacgctgtgcaatgtcacattccccctttcttgggctgtatcacaggtcgaaggcagattaacctgatctgttccgggaattattccgtctgagggcgcgttcggagtggaggtcagggcgccacttagggaagacgcttggagatccttggagttgacgggctgcaacttgcgatgctttcatattagggctcagacaccaccccacatcc

SEQ ID NO: 20415 - DNA, 538 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgcgtggattgccagctggcaatccacgcatggccggcaatccacgcatggcgaacgtctgccctatcaactttcgatggtagtcgccgtgcctacatgcgtggttaa

SEQ ID NO: 20416 - DNA, 464 bp, Homo sapiens
  misc_feature (325)..(325): n is a, c, g, or t
  misc_feature (327)..(327): n is a, c, g, or t
  misc_feature (335)..(335): n is a, c, g, or t
  misc_feature (337)..(337): n is a, c, g, or t
  misc_feature (344)..(344): n is a, c, g, or t
  misc_feature (366)..(366): n is a, c, g, or t
  misc_feature (371)..(371): n is a, c, g, or t
  misc_feature (381)..(382): n is a, c, g, or t
  misc_feature (392)..(392): n is a, c, g, or t
  misc_feature (397)..(397): n is a, c, g, or t
  misc_feature (410)..(410): n is a, c, g, or t
  misc_feature (425)..(425): n is a, c, g, or t
  misc_feature (428)..(428): n is a, c, g, or t
  misc_feature (430)..(430): n is a, c, g, or t
tctctcgccaggcgtttttttggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaactctgcctatatccggggatntnggcttgtntncacaggnggcctactagacaggacatttncggcnataggccacnnctccgtctgnccatnccatgtagtactntcaccagacattgtnggncngagctctttcaggttggtactaattcgggccatt

SEQ ID NO: 20417 - DNA, 429 bp, Homo sapiens
tctctcgccaggcgtttttttggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgctggcaataaggtgcaactgctgccgtgctggtgcattgcccatgtaggtactttcagccagacactgtttgggccagaagacctcttttcaggctcaggatacacataattcagggacattgaatctaggtagttcaggtacatagcttgaaggtagcacacacgtcgtat

SEQ ID NO: 20418 - DNA, 980 bp, Homo sapiens
  misc_feature (819)..(820): n is a, c, g, or t
  misc_feature (911)..(911): n is a, c, g, or t
  misc_feature (930)..(931): n is a, c, g, or t
  misc_feature (939)..(939): n is a, c, g, or t
  misc_feature (957)..(958): n is a, c, g, or t
  misc_feature (980)..(980): n is a, c, g, or t
tcccccgggctgcaggattcggcacgagctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtgtcgaatgttgcagtgctgctgagatgctaccactgtgcatagacccatctatataacggtcaacagctgctgctggagnngtacactcactgtgaaggcagggctctgtgtcattgcttgtgtgtgcctgtgtgtgcacaagtgtctgtgtgtgagccagtaggtgagcangagatcgagatcgacagtnngatggctntgctatacgacactagcnntatgcacagggatagtactttn

SEQ ID NO: 20419 - DNA, 802 bp, Homo sapiens
  misc_feature (787)..(787): n is a, c, g, or t
gcctgagctccctgcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgtgcagctgatcaagactggagaccacagtggggaggccgcgaagccgctggtggactggtcattttcccctttcccttggggcgggcctccgcgggggtgccgaggtggcgcttaaccttaggctgtgtccccgggaacggtttcctccgggggggcccgggccccctgcgcagtgtgcccagggttgccccccttcgggagacagcgcgctgggaacccctcgagtgccctttggcgcgctgngacgggtcacgtata

SEQ ID NO: 20420 - DNA, 1223 bp, Homo sapiens
  misc_feature (1113)..(1113): n is a, c, g, or t
  misc_feature (1115)..(1115): n is a, c, g, or t
  misc_feature (1125)..(1125): n is a, c, g, or t
  misc_feature (1131)..(1132): n is a, c, g, or t
  misc_feature (1141)..(1141): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaagggggggtaattncnggggcagtangtaccnnttgaagggntaaggaggggtaaaagagggggtaatgtggaggcgttgtagcattcggatggcaagaggagaatgaatcgtagaaagaagcg

SEQ ID NO: 20421 - DNA, 1569 bp, Homo sapiens
  misc_feature (1167)..(1167): n is a, c, g, or t
  misc_feature (1171)..(1171): n is a, c, g, or t
  misc_feature (1173)..(1173): n is a, c, g, or t
  misc_feature (1177)..(1177): n is a, c, g, or t
  misc_feature (1183)..(1184): n is a, c, g, or t
  misc_feature (1187)..(1187): n is a, c, g, or t
tctctcgccaggcgtttttttggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20422 - DNA, 1097 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaagcaaaaccctgacaacccccaccccaaggcttccatcttttgcatcaccaccactcctaaaagcccccttcttataaaaatttatttgcttttcaaggaaataaaaattaaattctttaaa

SEQ ID NO: 20423 - DNA, 867 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagcgggtttcggtactggagggtccccagtgccgggttgttgcattgtcccctgtggtctcccattatacagggacgtgcggtctgagggaaccccttgtagggaggttgtccctaggtgccggtggactcctgtgcgcact

SEQ ID NO: 20424 - DNA, 1518 bp, Homo sapiens
  misc_feature (1116)..(1116): n is a, c, g, or t
  misc_feature (1120)..(1120): n is a, c, g, or t
  misc_feature (1122)..(1122): n is a, c, g, or t
  misc_feature (1126)..(1126): n is a, c, g, or t
  misc_feature (1132)..(1133): n is a, c, g, or t
  misc_feature (1136)..(1136): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccaactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagtgtcctgctgctgctgcagccccagctaaggttgaagccaaggaagagtcggaggagtcggacgaggatatgggattggtctctttgactaatcaccaaaaagcaaccaacttagccagttttatttgcaaaacaaggaaataaaggcttacttctttaaaaaaaaaaaaaaaaaaaaaaaaaaaaaaaaaaaaaaaaaaaaaaaaaaaaaaaaaaaaaaaaaaaaaaaaaaanaaananaaanaaaaannaanaaaaaaaaaaaaaaaagggggggggggggtataaaaaattacccaggggggaggaaaagtattattgaagcacagccatatttttatgaaagaggggcgccactatataagggggagagatataataataacgcgaggggggggggttgatttaaaaaaagagacgttgggtgagggaaaaaaaaaatgagtggtggatggtatctatttagaggagaaccaccacaacctggtggtggcgggaataattattaggagaaccaatactcagacgaagatattataaggtgcgcgaggaagaaacattacaaatgagggatgtatgttggtgattacaacgacgagatttattgctggggaggaaaaagtttgcggatggaaa

SEQ ID NO: 20425 - DNA, 999 bp, Homo sapiens
  misc_feature (557)..(557): n is a, c, g, or t
  misc_feature (849)..(851): n is a, c, g, or t
  misc_feature (902)..(902): n is a, c, g, or t
  misc_feature (930)..(930): n is a, c, g, or t
  misc_feature (999)..(999): n is a, c, g, or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgtgaagatgataaanaatggagaaaaagtgggagcaagcgaagcaaagatgatgaaaatgttaaaaatttcccccttatactttgggatggtaataaagaaggtgttagaaaatggaagaatataaaaacttgaagtgattgatataaaagaggaaaatatgaattatagattaatggagggtgtcagaaatgttgcaagtgtatgtatgaagattggataaaaaaatgttgaataagtaaaaaattatataataaaagggtaaaaaagagtaatggcattgtatagtggagaaggattagaggttnnnaattgatgaaaaggtaaaggaattattggatgataaaataatgaatttgtngatgatgaaaaatgtggatgatgaaaanaaagatgataatgatagatagatgaagaaaaagataaggtatagaagaaaaagagaagagtaggaggan

SEQ ID NO: 20426 - DNA, 715 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccaactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagtggggcggtccgatgctcccaggcttactccaatgtatact

SEQ ID NO: 20427 - DNA, 699 bp, Homo sapiens
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagccgtcggttccagctttaggtatcacactaaaatctcgatgatgtgcagctgatcaagactggagacttctttggggtggtcaccaacaaggggttcgcaatggaggatttacaaccctgagtggttggtattacaaaggaactctgcttcttcgttcttgagggggggcgcaatgttgccggggttgttttaatttggtacccaaccgtggcttagaccccttctctttaacaggggaaacaaatcttg

SEQ ID NO: 20428 - DNA, 435 bp, Homo sapiens
acctgcttgactctcaggatagatctcttgctctatagaatatgtgatctcttgttgaggaaacacctaaaacctgatgtgcagaatggggcaggggcagaaacagttgtggtgaacagaaatagcacctgaatttcaggaggcccatatgtcagaacagtaggccttgaataggcagcatgatttattgtgcaaataaaaatggatggaaatgatttttttataaagcaataagaatggggagatttagtggctaggtgtcttagtctatttgtgctgctataacaaaatacctgagactaaagtttggtcaggttggctcatatctataatcccagcagtttgagagggccactggggaggatcgcttgagaccaggagttcaagaccagcctgggctgcatagcaagatctcatctctacaaaaaagaaaaa

SEQ ID NO: 20429 - DNA, 1569 bp, Homo sapiens
atgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttcaaaaaataatt

SEQ ID NO: 20430 - DNA, 1515 bp, Homo sapiens
atgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttcaaaaaataatt

SEQ ID NO: 20431 - DNA, 831 bp, Homo sapiens
tgatacctgactctcatttatgacacaatctgtgtatgaaatagcccaaattagtatcagcctttggatagtttaaaaaatgattttttttttggtatgcttccctatcatctccatctgccccagaactcaaggtctgtccatgctggtgacttagagtagtgggatttaaaccagaggatgcacacttggaggcacttgaagatgtttcaagggacatgcaggcattgaatatttaaaggaaattaattgccgattcttagatcttgagtgttaatcagttctaacactgaccgtcctgagaaaatgcctatggcccaggtgacctgctggttttcctttcacaccttctctttcatgattaccattctttaaagggaagacatacctttcacctaccccttatcagagtgccaagtagggggataattaaaatactgctggggctgctgggaaaagtgagtgactctaatgactgggcaaaggaaccttttgcaaatgtttcccatttttgcattcagtaaaattgggcagggtggctcatgcctgtaatccaagcgctttggaaggctggggcaggcagatcagttgagcccaggagttcaagaccagcctgggcaacatgtcaaatcctcatttttacaaacaaaacaaaacaaaattagctggacgcggtggcacgtgcctgtagttccagctacttggagggcactgaagtgtgggaggattgcctgagcttagggagtttgaggctgcagtgagccatgatcatgccagtgtactccagcctggacaatgtagtgagaccctgtctcaaaaaaaaaaacaaga

SEQ ID NO: 20432 - DNA, 883 bp, Homo sapiens
gaaagatgtttttaaaagcttggcccaaagaataggaacttagctagcatgtatacaaaatatatttgaggttactaaatgaataaaaactcggaattaggccaggagacatggaataccattcatgggatggttatcacaggagtttagaaagactctgcctcccagcatcttgaatatctccagcctgttcactgttttcttcctacatgatctttacctgttgttagactgtggccacagccagtaaatcaggccagagtgtctcaaactggacaagaaatgtgctgcattgccgagttcttattttcaccttttcataatcccaactacaataacaagaattttattgactaataagggaatatgtatggaagaaggaagagaaagcctttgtctagcatttattaggaggatcagagtgagtgggaagtttcacaacggattgatctgatcaatcccttcaaggagctgaaggcaaaatgtgtaaaacccctaaatcagattgaaaagcctatttcattgatatccaacatgtttgatgtttaagctagctttacctaagccacttctcagcctccagaatactctctctggggttgtgagtcagtcagcccacaagcattcacagagtgcttacctgccccgagggaagtccagcagctccaccagatagagatctggagatgcttctctcactgtgcttggcttcatctggggtgcaagggaaggcattatcgggtggctcccttgctccaggaactgaacgaggcccttttcataccttaaatatattctgcacaacaaatgggtattgttagtctccatttcatagatgaaaatagtgaagcccacagaaaataagtagctcctccacaggttg

SEQ ID NO: 20433 - DNA, 571 bp, Homo sapiens
tttttttttgagagggagtctcactctgccacccaggctggagtgcagtggcacgatctcagctcactgcaagctccacctcccgggttcacgccattcgcctgcctcagcctcccaagtagctgggactataggcgcccgccaccacgtctggctaattttttgtatttttagtagagacagggtttcaccatgttagccaggatggtctcgatctcctgacctcgtgatctgcccgcctcggcctcccaaagtgctgggattacaggcgtgagccaccgcacccggcccagtcttctaattatttagtgaattcagtacgttgacatggggctgaaaaatctgcatttctaagttctaagttctaagccaagtcattcactaattatgtcaattctatccctgaaaaataagggcttgtatcaccaaacggatgaaataccatttctgaactcaaaagctgaagcaactccctactccacatttattaattacagcctgaaggaaattgctcacatctatgcaccccacagacaaaagggcacagttgctaaaagaacagttccaaact

SEQ ID NO: 20434 - DNA, 357 bp, Homo sapiens
acacagagaaataccgtatgatccagtgattccacttctgggtatatgcctaaaagaatcgaaagcaaggctggacacagtggctcacacctgtaatcgcagcactttgagaagccgaggtgggaggatcgcttgaggccaggagttcaatgccagcctgggcaacatagtgagatcccacctttacaaaaaattacaaaaattaaccaggcatggtggcgttgcctgcagtttcagctactccggaggctgaggtgggaggattgcttgagaccaggaggttgaagctgcagtgagctgtgatcactgccctgcactccagcctgggtgacatagagagaccccatctcaaaaaat

SEQ ID NO: 20435 - DNA, 300 bp, Homo sapiens
ataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacact

SEQ ID NO: 20436 - DNA, 362 bp, Homo sapiens
gccaactcagttcatctttctgcttgaaaccttccctgaataggccaggtgcggtggctcacgcctgtaatcccagcactttgggaggccaaggcaggcagatcacaaggtcaggagatggagaccatcctggctaacacagtggaaccccgtctctactaaaaatgcaaaaaattagctgggtgtggtggcgggcgtgtgtcgtcccagcttcctgagtggctgggactacaggcaggcagtgaatttgaaaacttttgttgtagagacaagatcttgctatgttgcccaggctggttttcctgccactttagagcaggtttcctttttttcatacttttaagagttttttattaggaatt

SEQ ID NO: 20437 - DNA, 289 bp, Homo sapiens
agtgtaatagcagattgatatgttgcctatatttcctttcactcctgggctgcgtgcccagcagagaggtaagaagggacagacatcagggccaaccattgccccctgtagccctcccttccaatcttctgttcctaacccagggacattaaggccagcgaaaaattttcctccagagaggtattcctatttagtctaacactgtgggcagtgcccaagtagaggtggagaaggccatctgattcagggccagacatttgtgaagcgcttcaaatagattcatcttcaa

SEQ ID NO: 20438 - DNA, 547 bp, Homo sapiens
ctgcacagctgcaggctgtgaggtatgtggtcaagaaatggagataaagctgtttctgagttcaaacacagtaggaaggctgcgaaatggctgcattgcccggctgtgtttgcatcctctctctgccatttgagggcagtggattcagcatgcatctttgaaatatatcccagcttgtcagaggtaagtgcctgttttgatggaaggagagtggggaatgcattacgggggaaatgtagcaaaaggcaagcagctctgagttctgcatcctactttcaatgatatctcaaagggcttgtgaatcaaggtactgctctcttgtagacatcttgaaaaatgaaagaattctaacgtattatggactttaccgtttatttaacaacagtttagatactttatggttctatttgttagatcccccttttaactttttgaaaatttccaacatatataacatggagagggtattagaatagtgttccaaggactcacatacccatcacccagcttcaacaactgccaactgatgttaagtaaataagccagg

SEQ ID NO: 20439 - DNA, 720 bp, Homo sapiens
gtcagtttctgtaagtcaccagtcactagccccttgattccttgttaaagacttctgtgcagccttatctaaaatgataatcttaggctgtgagtctcctgctgtattgttcctaaaatcgtatggatagaagaggtgcccttagtcatccctttacatatgtggtgctttctaatgggatctctatgcatcacatactatgcaggtgaatttctcactgttcagataggtcatcagtaaaaggcatcacttcaagataattactttgaattgaggtttggcctcttttcctgctttgtaatgggttcggtcatgagggtgggagctgtcattcacatttatgggcagcattcctgttgattagtggacctaagagccaagtaggaaaatatagcatgctatgtgatacaagctggagatgctgtagtgttactatcagcaagttctgtgcagactgcctttcggattccagatgatctgtcaagggtctgccaactgtgggctggtcgcttgtttgtgtaaataaaatgtgtttggaatatagccacacccattttcttaagttctgtctgcggctgctttcgcactgcaagagcagagttgagtagctgcggcagagacccgtgtggcccttacagcctaagatactatctggaccttcagaaaacatctgctgatccctgcttgagaaagtcatccttttcaggaacaaatattctt

SEQ ID NO: 20440 - DNA, 606 bp, Homo sapiens
cggccgctatgacatcatccccgcggtgtgtaactcgagaagcatgttgggaagtgttgggactgattgatcacgcgtgctggtgtcctctccccggaggctgaggggccgggctaaggcggcagctggctgtgtctctcaccagcactcagggtggggggccgcatcttcattccaccgggcggcattgggggaagatcctggcagggcctcattttcagatgagcacaccggggcccgctaccagggcactgcaataactcacagggtcggggtcccttccagggtctccctcagccccacctcaaccctcaaccctcactgcctgcccctgcctggctccctgggtggcctgctgtcacaggcccttctccacaaaggagaagacacaggaggaaagggctgggggatgctgtgcaaggcatctgtgggtgatgggtccacactggtgggtctggaggaggttgggacccaggctgcctggctgatgctgtggacatgggaggaatggcagctttgttttctgtcattttgtcatccgaggctggatcacaggcagatgcatctgagaggccagatcaggcacgcggcagacccaaggagctt

SEQ ID NO: 20441 - DNA, 363 bp, Homo sapiens
ggagaatattagcagccagtgaacatgatagatggaacttattgaaatagatatttaagatataagtgaagaagccagatttgattacactaaatatagtatgaccctatttttgcaaaaagcatagaatttttgctagaggaatacatgctatattattaacgttaggtatctttggtggtggtattataggaagtttgatttttctttttcctaaagcgaatggtttttggctgggcgtggtggctcatgcctgtaatcctgacactttaggagtctgaggcaggcagatcacttgagcccaggagttcaagaccagcctgggcaacatgatgaaaacccatttctacaaaattaatacca

SEQ ID NO: 20442 - DNA, 1068 bp, Homo sapiens
gttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 20443 - DNA, 1109 bp, Homo sapiens
gttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaaaacaaaaaaacaagaaaaaaaaaaaaaaaa

SEQ ID NO: 20444 - DNA, 1007 bp, Homo sapiens
cgtgacgcgtgggtcgacccacgcgtcgatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtccttt

SEQ ID NO: 20445 - DNA, 644 bp, Homo sapiens
ccctccctccgcccagcctccctgcctccatctccgtccagggcagccccgggccctgctccccactgctaagtgtgtctgctgagcgctggcccccattgagtcctgagggctggggcggggcggggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaaaacaaaaaaacaagaaaaaaaaaaaaaaaa

SEQ ID NO: 20446 - DNA, 312 bp, Homo sapiens
gccactgacccgcgttccatctcccggcagctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccgggtgagtactatgagctgtaggccctcctcgagcgccagggcctctctgcacactcacaggcacacacatacacacaccaacgtgcagacacgtacacacacaacaca

SEQ ID NO: 20447 - DNA, 1231 bp, Homo sapiens
gttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagatggagtctccctctgtcacccaagctggagtgcagtggcgcagcctctgctcactgcaacctctacctcccgggttcaagtgattctcctgcctcagcctctcgagtagctgggattacagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaaaacaaaaaaacaagaaaaaaaaaaaaaaaa

SEQ ID NO: 20448 - DNA, 807 bp, Homo sapiens
cgtgacgcgtgggtcgacccacgcgtcgatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaaaacaaaaaaacaagaaaaaaaaaaaaaaaa

SEQ ID NO: 20449 - DNA, 784 bp, Homo sapiens
cacccagtggccgcgctgcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaaaacaaaaaaacaagaaaaaaaaaaaaaaaa

SEQ ID NO: 20450 - DNA, 2340 bp, Homo sapiens
gttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgccacgagggagctggagacagggccagcgccacacggagcccggcggccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtccttt

SEQ ID NO: 20451 - DNA, 2045 bp, Homo sapiens
aacagctgtacgcccggattacgggatcgaggcagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgccacgagggagctggagacagggccagcgccacacggagcccggcggccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtccttt

SEQ ID NO: 20452 - DNA, 1255 bp, Homo sapiens
gttaaccgaaaggttggtggttcgagcccacccagggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtccttt

SEQ ID NO: 20453 - DNA, 856 bp, Homo sapiens
cgtgacgcgtgggtcgacccacgcgtcgatggcggtgctgtcagctcctggcctgcgcggcttccggatccttggtctgcgctccagcgtgggcccggctgtgcaggcacgaggtgtccatcagagcgtggccaccgatggcccaagcaggcctctggcagcggccgtgggggctcgcatccgcctctgggaagcacctgcgtggctgacgcctcctgtgcccgtgtgtctctgtgccagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 20454 - DNA, 2105 bp, Homo sapiens
cacccagtggccgcgctgcagctcctggcctgcgcggcttccggatccttggtctgcgctccagcgtgggcccggctgtgcaggcacgaggtgtccatcagagcgtggccaccgatggcccaagcaggcctctggcagcggccgtgggggctcgcatccgcctctgggaagcacctgcgtggctgacgcctcctgtgcccgtgtgtctctgtgccagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgccacgagggagctggagacagggccagcgccacacggagcccggcggccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtccttt

SEQ ID NO: 20455 - DNA, 439 bp, Homo sapiens
cattcaggggcatcaaaccctggccctggcccctggaggctgcccacagcctctccatcgggcctcacctcacccacagcgacaaagtaccatcacctgggcagcttcaacagaagctgattgttctcacagttctgggggctggaaggccaagattgggggtcagcagggttggttcctgctgaggcctctgtccttggcttgcccgtggccatcttctccctgcgtctttcctctgtacatgtttgtgtcctgatcgccttttcttacaaggacataagtcatatcggatgagggcccaccctcgtgacctcactgtcctttataatgaccctttattttattttttgagatggagtctccctctgtcacccaagctggagtgcagtggcgcagcctctgctcactgcaacctctacctcccgggttcaagtgattc

SEQ ID NO: 20456 - DNA, 505 bp, Homo sapiens
cagtctcgcagcagggaggggagaggcaggacaacagtgagtgcggctgggggagctggaggggcctgggacagccactgacccgcgttccatctcccggcagctccagcgtgggcccggctgtgcaggcacgaggtgtccatcagagcgtggccaccgatggcccaagcaggtgaagctggccttctgggggaggtcgtaccccctcgccccacccccatcccttccttattttctgcatcagtgccgcagccactgaggtgcatggatggggcagggagggggtcacacatcccagtccctgacctcatgtgggtccaggcctctggcagcggccgtgggggctcgcatccgcctctgggaagcacctgcgtggctgacgcctcctgtgcccgtgtgtctctgtgccagcacccagcctgccctgccaaaggccagagccgtggctcccaaacccagcagccggggcgagtatgtggtggccaagctggatgacctcgtcaac

SEQ ID NO: 20457 - DNA, 1048 bp, Homo sapiens
atctagaggatcgggagaggaacgtcactcatccattgtccactgactctccatctatccatccatctattgtccactgacgtctccatctgtccatctatctgttgtccactgacctgtccacccatctgtctgtagtccactgacctctccatctttccgtctgttgtccactgacctctccgtctatccatctatctattgtccactgacctctccatctatccatctattgtccactgacctctccatctatccatccatctattgtccactgacctctccatctatccatccactgtccactgacctctccatctatccatccatctattgtctactgacctctccatctatccatccatctattgtccactgacgtctccatctatccatctgtctgttgtccactgacctgtccacccatctgtctgttgtccactgacctctccatctttccgtctgttgtccactgacctctccgtctatccatctgtctgttgtccactgacctctccatctatccatctattgtccactgacctctccatctatccatccatctatggtccactgacctctccatctgtccatccactgtccactgacctctccatctatccacctattgtccactgacctctccgtctatccatccatctattgtccactaacctctccatctatccatccatctattgtccactgacctctccatctatccatccattgtgcactgacctctccatctatccgtcttctatccaggcctccattcatcccccatctagtcatcctccatccatccaccagacatccactcctgcccctacccacccattcactagacaccaaaatccggtgacgaattatttgcagatggacccctggggacgtatgtcacgaatgtacatccccaggtcccatggtcagagtcggcaggtgtgagtggggcccaggaaactgcattttcagaagactctaaattagaatcagacatggctgctgtgtggattcacccttcaccgtcaccctgcagaggagcaag

SEQ ID NO: 20458 - DNA, 880 bp, Homo sapiens
cgagcctgtgaggacccagcaagaaggtgccattgtggaaatggccctcaccagacaatgaatctgccagcaccttgatctgggtttcctagcctctagaactatgagaaaaaaatttctgttgtttataaactacctggcttatggtaactttttatagaagccagaacagactaagacatcacatccactcaatcatcaagtctcatggattctacctcaaaagtatcaccaaaacctgaatgtttctgtctcccctgtccccatcctatccaacagtactcacctgggttacctgaaagagcccgctgatgactttcatatcacacttgttctctgtcaacacagctaacacactgccatttaataaaagaagtattaaaaaatgtttgctccctgaaactcagcagaaaattccagcattattgcgggaagacaacactagatgttcatctttccagtctttgctgcacagaactagagggccaggtaccagatgattatgatgatttcatcatccaatttgacaccttccattggcttcccattgtccttagggacatttaaattttcaacatgaccttcctagtcattacttccctgccagtgtcaactccagctgttctttttctcttacccctctccagctacactttctctcaattcatcaaacataccaagctctttgagaattgtgcacatacttttccttttacttggaacatccctttcaattcctacattctttgttttaccctccttatagcaatatgcttgtaattgaatattaattatgtaactaataaaatttcattgtctccatgggaggagagaccaggaacatggtagatgcttaaaattatgcactgattgaaactac

SEQ ID NO: 20459 - DNA, 1519 bp, Homo sapiens
gtttgaggaagatgaaagagttctggagatggaaggtggtaatggttgcacagcaatatgaatgtgcttaatgccactgaactgtgcacctaaaatggttaaaacggtattttatatttgtatattttatcgtaataaaaaaatagtgctgagctcactgtcactggaaggatacaagcagaggagagacactcatcagccggcactgctgaggcaggatttctggaccacaaggaaggtggccactaagggttgccctctggccccctgtgactcttctcatcagcatggcccaggatgcagcatcctggcatccaaggaggtgccactaagtagctacaagatgtggggcctggcgagaggaaccacaaaagaacgcagaaaaaaaaagcaacaaaaagccagtgacaaagctgcgtggatggcggaaggcgagcaggagtttggtgatgcagtttgaagaccgggactgagacccccccactggaggggtacgtggggtgcaaaagcagaagtggcaccagtgggcttgactgctccagagaggggcattgctcctcagtgcagcaacaaggcgcctttagcccccttgtcgtttttggccccaaaagtgccacagttacacagggtggccctggagcaaagtgagtgctaatgcgctggggcatacggaaatctggtatttcacacatttgtcatgttaaggagaattaggcgtatcagagtatctaacagattggccttccaatccccatttaaaacgggtaattgagtagctgattttaagcttatgattttaagcagaacaccggaagtggattcagccaagtttgtaagttttgaaatgtttcagagaactaatagtcatcatatttatcagcttattaaatttcaagaactatttaggaacccaggaaagtcctgctttttaggatgagtatttataaacttaagaacactggttatgttaaatttataaagttacatcaagatatttaaagaaatttaattacttaagttataaaccccctacccttgaacatcgacatttaaatggactagattcgtgaggggaataatgaaattggtatgttaaatgcttcaggaaacactaggtttaaaaatttccacttcaatatatattgaatattgagaaaattcaagtcgttgtaagtagtctgtgtgtgtgtgtgtgtgtgtgcgcgcgcgccccaagaataactaatgacagataatgcagatgaggtgggcaccctgcagagtccagggcagggagcatcagcacagctagacagggaggactatgcagttaagagcccgaggcacactgctcaggcttggaagacaccaaagcaaagcagactagcaaaagtaataaaagcaactgctacatcccctccccctaacaaaaccactggacggcatgggaaccctgtttgaaggtgaggcctcctcacagtcctgctgatgtctaaggtgggcattgcccggctcctggtcccagtcttgggggttgcct

SEQ ID NO: 20460 - DNA, 728 bp, Homo sapiens
gtttgaggaagatgaaagagttctggagatggaaggtggtaatggttgcacagcaatatgaatgtgcttaatgccactgaactgtgcacctaaaatggttaaaacggtattttatatttgtatattttatcgtaataaaaaaatagtgctgagctcactgtcactggaaggatacaagcagaggagagacactcatcagccggcactgctgaggcaggatttctggaccacaaggaaggtggccactaagggttgccctctggccccctgtgactcttctcatcagcatggcccaggatgcagcatcctggcatccaaggaggtgccactaagtagctacaagatgtggggcctggcgagaggaaccacaaaagaacgcagaaaaaaaaagcaacaaaaagccagtgacaaagctgcgtggatggcggaaggcgagcaggagtttggtgatgcagtttgaagaccgggactgagacccccccactggaggggtacgtggggtgcaaaagcagaagtggcaccagtgggcttgactgctccagagaggggcattgctcctcagtgcagcaacaaggcgcctttagcccccttgtcgtttttggccccaaaagtgccacagttacacagggtggccctggagcaaagtgagtgctaatactctgatacgcctaattctccttaacatgacaaatgtgtgaaataccagatgtccgtatgccccagctgca

SEQ ID NO: 20461 - DNA, 1135 bp, Homo sapiens
gtttgaggaagatgaaagagttctggagatggaaggtggtaatggttgcacagcaatatgaatgtgcttaatgccactgaactgtgcacctaaaatggttaaaacggtattttatatttgtatattttatcgtaataaaaaaatagtgctgagctcactgtcactggaaggatacaagcagaggagagacactcatcagccggcactgctgaggcaggatttctggaccacaaggaaggtggccactaagggttgccctctggccccctgtgactcttctcatcagcatggcccaggatgcagcatcctggcatccaaggaggtgccactaagtagctacaagatgtggggcctggcgagaggaaccacaaaagaacgcagaaaaaaaaagcaacaaaaagccagtgacaaagctgcgtggatggcggaaggcgagcaggagtttggtgatgcagtttgaagaccgggactgagacccccccactggaggggtacgtggggtgcaaaagcagaagtggcaccagtgggcttgactgctccagagaggggcattgctcctcagtgcagcaacaaggcgcctttagcccccttgtcgtttttggccccaaaagtgccacagttacacagggtggccctggagcaaagtgagtgctaatgcgctggggcatacggaaatctggtatttcacacatttgtcatgttaaggagaattaggcgtatcagagtatctaacagattggccttccaatccccatttaaaacgggtaattgagtagctgattttaagcttatgattttaagcagaacaccggaagtggattcagccaagtttgtaagttttgaaatgtttcagagaactaatagtcatcatatttatcagcttattaaatttcaagaactatttaggaacccaggaaagtcctgctttttaggatgagtatttataaacttaagaacactggttatgttaaatttataaagttacatcaagatatttaaagaaatttaattacttaagttataaaccccacaccctctgtgtgaaacaggcctctggaaacagatgcccagccgttgccaagtgtaacttaattaaaatccgagaaacggctttagcaacaaataaatatcaaaa

SEQ ID NO: 20462 - DNA, 1232 bp, Homo sapiens
ttcagacccttaatttctcagaagtacaaattttaggcaaacttcttaaatttatactggattatcttgatgtctctacatatatgtttaaaccatagtaacttagattttgtactagaaaatctctaactcttaaaagcagatatatttatagcttagttactatcaagagaagtcagaaagagtatagattttggaactaaacacattcgagtttagatccctacccagttacttacagaaataagtagtattagacatatcgttttatctctttatgtctttatgtaaacacagactgttcttgacagtttacatcagaatcacctatggtacttgggaaaaaatttggatttcttggccccacccatgaccaattacaaaataatttttatagataggcttagaaattttatgtttaacagattctgaggcagtttttgtactattgatagtctagaactttagtttgctttatttgtaacttagagacaatatctacttcagatggatgctgacaagattcttagatcatgcatataaaatatatagcactggaccaaggacttagcagctcttagttgtagctattatactaacataggggttggctaaacattttctgtaaggggctatgtagtacaacttttaggcattgtgggctggatagtctccattgcaacatttcagctgtgtgttgaggcatgaacacagccatagacaatacatgagtgagctgtgttcaaataaaactttatttccaaaaataggtggtggattggatttgagctgaaggtacatggtttgccaaccctgtattatgtttatagcatttgttttacaaaatatacctgattctgaaaaaatgaaaaatggttactataggctagatagtaggtagttaagtcctataactactagtaggtagttataggacttaattaacagatagatatgatgtgacaattcagtttaagtgcaactttcagtttctatcttaactataacttgagagattaatttagaattacaaatgtgtgtatatatatatatgagcatatgtatacataacatatttacacacaaggcacacatactatgagcaccctgcagtttgtaggcatttttacatgcgaatgttattggaacagataggcatcacgggaagaaattttgcctctacctgctctcaccatgtcagttgacaggactcaggacatgggagaagagtg

SEQ ID NO: 20463 - DNA, 586 bp, Homo sapiens
tgcaaaactactgtagtcatttccgcttgtggaagataatgtaatggttcatacagcatgtttgctcagtaatatatgtggccaagaaagggtttttttccctcattctctccctcttggttttttcctagtgtgtctgcacattcttctcatttctatccatgcacattttctttctttttttggtgggggaggcagagtctcattgtgtcaccgaggctggagtccagtggcacgatctcggctcatggcaacccccacctcccaggctcaagcggttctcgtgcctcagcctcccgagtagctgggataacaggcgtgtgccaccatacccagctaatttttgtatctttagtagaaccagggtttggtcatgttggccaggctggtcatgactgagcccggcccatgcactttttcttatgtgaattataagagttaaatgtaaacgaatacagaaaaagtattaagctatcaaagggagggaagctacatttaagtgtaaacatgcttaaagaaatagaaaagaccagtcagttacaatacataaaattaataaaaactttaatggaaaatcaatagtgat

SEQ ID NO: 20464 - DNA, 361 bp, Homo sapiens
ggggctgaattaagagaatggctctgggggtggagtatgagagtatttcctaaagatagaagagagaatggccaggacttgagagtggctgaagtcgggtacagggagacaggagacaccttttatggccatagcttgagtcactgtgtggacaggcgtgctcatcattgagaccaggaagcttggaggggaaaacgctcatatgcaattctgaagttcctaagagacaactggataacacacaaggatgaatgtgaaacaaacaaggggctaggtcccgtaagctcatcagaacttctttctgaaagaagtaaagcacatctctaatgacaacagaaataaccacaaacctgcgagtcag

SEQ ID NO: 20465 - DNA, 489 bp, Homo sapiens
tgtgaggtacatgtgaagtgaccacgtctgttcttgttgggggcatctgaggtaggagaggaagtgcctggtcatcgcagacaggctgctgctcagctggcacccactgtcctgtggagagcattggccccggcttagaagaggacgggccctcccaccacactggccaggccacccccagcctgacagaaagtcatctttccggccggatgcggtggctcacacctgtaatcagcactttgggaggccaaggcgggtaaatcacttgagctcaggagttcgagaccagcctggccaacatggtgaaaccctgtctctactaaaaacacaaaaaattagctgagcatggtagcaggcgcctgtaatcccagctactcgggaagctgaggcaggagaatcacttgaattcaggaggcggaggttgcagtgagccgagatctcgccattgcactccagcctgagccacaaagtgagactcgtctaaaaaaa

SEQ ID NO: 20466 - DNA, 696 bp, Homo sapiens
acatagactaaaagagggtcatgtggtggtgggtggtaggactgcttctgcatttttgtttcctcttgtaagggctgtgggaggtgggtggcctcagtgttggctgctttgtgcacataaaaacatggagtgtttagtgactctgtcttcagccctgcccattagcggaaattctgtaccatgagatgaatccaagttgacatcttgtttcatatcctcagtcactagaatgtgctgtcatgctggttgttctctatttgtccctctgctcaggttctgttctccatcctttctgtcctgtaaatgtgccctggagagctgacttctgtggattatattatcttggcttccttctcctcttgcttctggtttgttttgactcatgggaggcactggtgtaaggttggagagtaataaggaaattggggtatttataaccctgaccctgtcccaactcatgttcctctgtggcttcagctgctgcctggtggcccctcttccttagctccagctgtaactattctctcagtttaaggctggtaaaacttcctgctggtgctgatccctgttgtattaccatcctgtgtgggtttcctcaatctcttgctgcttctttgactctgtccacacctgtgaagagtctcttcattagaacagtttcagttaaatcctttgagtgggccatctgtttcctgc

SEQ ID NO: 20467 - DNA, 506 bp, Homo sapiens
gtctctcagaaatcaactacacatggtctcagcttttaagggctcatagtgattagattggactcatatacggtcctcattttaatattcataattctaactgcaaagtctcttttgtcaggtaatacagcatattcaggtctcaaggattaaagtgtgagcatctttgggggtttttattctgcttacaacatttacctagagtataaattcaagacataaggcagaatcttatgagaaaaagaaagtactattttgaacatacctgtggcaatcctaaatgggaattagattcagatttggcagttctggataaaagtgaaggctgaagaaataatttggtagtcatcatgttatacattttgtaaatgaagccattattacatatgagagggttagcattcacccagggagacttcaagtcagtttacaaagttaatattctatggcatgttcaatagtagcaccaccttttattcaattggatagtagcctggggtgaagat

SEQ ID NO: 20468 - DNA, 308 bp, Homo sapiens
agccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaag

SEQ ID NO: 20469 - DNA, 422 bp, Homo sapiens
gacctgattggctgctgatctgatgagacagcgacagatttaatggtgtttcacctacctggggtttagtttttttagttactgatttaccttagcagttttcacttacagtcacctaatttatctgtgttttattgacaggtgcaattttttaatgagggctgtggaagcagagagaggttttgaatttcttgatgttttctgtggggtctttatatgatgatagcttgatatttttcctcctaatgaatctgtgagacttgtcacgatggacaaaaaccagtgacataaaaaagaaccaaatatgtttatttggaagagtgcaagtaaaaccttaaggcatgttactggtttctagtctattttagactttttattttacttaaaagtaagcacctataaggtactttttgcttctcaaa

SEQ ID NO: 20470 - DNA, 1749 bp, Homo sapiens
ttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatccccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttccctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttactcaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattattcaaatcat

SEQ ID NO: 20471 - DNA, 1698 bp, Homo sapiens
ttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatccccccttgtgatgcacaggaaattattttttagttatcatatcaaattgagaatttgtggtgaaagaataggaaaaggatgctagatgctgatctttctttttcaggatttttccctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttactcaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattattcaaatcat

SEQ ID NO: 20472 - DNA, 2519 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggcccacagggcctgccccaagcggcggccacacagggtgttgtggagatgggccagaggggcctgggcttggcggtgccaggctcgtgagaagcaggaaactcaaggccagccctgccacatcacggggcacccactgggcgtgaggcagagcccgcggctgtggggcagctccagccctgcccacaggccaccctcgcccgcacaggcagcactgaggccgggaccctgctggcgcccgatccgccactgcagaagagaccctctgtggacacccacactctgcagggactggcccccaactcaccccgtgctggctggtggggtccatttccccgcagcgggtatggaggatgcgtcgaggtccctgtctctgtcaatgtcatgggaaccaaaagtcactgagccgtcctccccccacctccgagcacagggcctggagggcaggggctccccgaaggctgggggttggagaagggtgaggggcttcccccagggatccccccacctggcctgctcacggggccttggagcatgagaccagtgaccccgagttttgcccatatcaggacagtggctccttctcactcccctttctcaggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20473 - DNA, 1684 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcagtgttcaaggggaagacatacaaccagctgcaggtcatcttccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcgccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20474 - DNA, 1816 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcagtgttcaaggggaagacatacaaccagctgcaggtcatcttccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggccactgaggccgggaccctgctggcgcccgatccgccactgcagaagagaccctctgtggacacccacactctgcagggactggcccccaactcaccccgtgctggctggtggggtccatttccccgcagcgggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20475 - DNA, 2614 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcagtgttcaaggggaagacatacaaccagctgcaggtcatcttccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggcccacagggcctgccccaagcggcggccacacagggtgttgtggagatgggccagaggggcctgggcttggcggtgccaggctcgtgagaagcaggaaactcaaggccagccctgccacatcacggggcacccactgggcgtgaggcagagcccgcggctgtggggcagctccagccctgcccacaggccaccctcgcccgcacaggcagcactgaggccgggaccctgctggcgcccgatccgccactgcagaagagaccctctgtggacacccacactctgcagggactggcccccaactcaccccgtgctggctggtggggtccatttccccgcagcgggtatggaggatgcgtcgaggtccctgtctctgtcaatgtcatgggaaccaaaagtcactgagccgtcctccccccacctccgagcacagggcctggagggcaggggctccccgaaggctgggggttggagaagggtgaggggcttcccccagggatccccccacctggcctgctcacggggccttggagcatgagaccagtgaccccgagttttgcccatatcaggacagtggctccttctcactcccctttctcaggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20476 - DNA, 2357 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcagtgttcaaggggaagacatacaaccagctgcaggtcatcttccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggcccacagggcctgccccaagcggcggccacacagggtgttgtggagatgggccagaggggcctgggcttggcggtgccaggctcgtgagaagcaggaaactcaaggccagccctgccacatcacggggcacccactgggcgtgaggcagagcccgcggctgtggggcagctccagccctgcccacaggccaccctcgcccgcacaggcagcactgaggccgggaccctgctggcgcccgatccgccactgcagaagagaccctctgtggacacccacactctgcagggactggcccccaactcaccccgtgctggctggtggggtccatttccccgcagcgggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20477 - DNA, 1626 bp, Homo sapiens
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcagtgttcaaggggaagacatacaaccagctgcaggtcatcttccagggcatcgagggcaaaatccgcgctggtggccccaacctggacatgggctactgggagagcctcctgcagcagcttcgtgcccacatggccgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcaggggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataaaaaaaaaat

SEQ ID NO: 20478 - DNA, 496 bp, Homo sapiens
gttctttgagctgtggctggagccagagtggctgggatgtgggagcagcatctctaggcagcacagggcacagagccctgagcctgtcctccaaaaaccattctgtcctcctggacctcttagcttgtgatgggagagactacctatcttctgaagtgcctttggggacttttccccattgccttaactatcagcatgattaacttttagtcatgctctcttgcaagtcatctctcttgcaaatggttgctccacagcacccttggattcctctcctgaaaatgctttttccttttctattacatggccagactacaaatttttcaaatttttatatctgcatccctttaaattataaattccacctttagatctgtgaaaggtaaataaatgtcagacctcaaaatcactaatccaaggggaaagtcaagctaggaactgtgtcaggaaaacctgcctctcattttgtttgtaaagaagatagctacaaagatta

SEQ ID NO: 20479 - DNA, 701 bp, Homo sapiens
gattgtgccactgcactccagcctgggcgacagagcaagactccgtctcaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgactgcgagcggcttcc

SEQ ID NO: 20480 - DNA, 307 bp, Homo sapiens
tacaaaaattgattcaaaatttgtcatagaccttaatagaaatgtaagtctataaaacttctagaagaaaaatataagaaaaaatctacatgacttgggtaagtgaaagaatttttagaaatgacaacaaaaatatgatccataatgaaaaaataaattagactttgtcaaaactgaaaacttttgcttggtgaaaagcactgttaaaggactgaaaagacaatccacagaaagaaaggaaaggtgtgtaagttacattttcataaaacgtttaatccagaatatgtataggacaatataaataaac

SEQ ID NO: 20481 - DNA, 329 bp, Homo sapiens
caaattgggataagtacctgaaagcaataatactggatctctttaaaatactctatagcatttattgtattgttttgactaaagatttttatgtcacagagcatacagcaagcacagtataaactttagagtgagctacttttctgtaacactatgcatgaaaattcacagaatatgtcaatctgttacttaaaataacttcagctcttatttttttaaatatgcagaaatcctttgcaaaataacttaccttttctgaagtcaatcttgagttaaaactaaacataattagatataaccaaaaaagaaacacaaaagtatggtatctt

SEQ ID NO: 20482 - DNA, 218 bp, Homo sapiens
ttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatc

SEQ ID NO: 20483 - DNA, 418 bp, Homo sapiens
  misc_feature (69)..(69): n is a, c, g, or t
tttgactcacctgaaatctcaggccaggaaattagtggcaggctggaactagaaaccatagtacccaancttctctaggccttactcctttctcctctgaacagcttgctttgagtcaaatggaaaaggtctcagcttagaactggaccctaatttgataaactagtttttcaggatttgtttagagtaaggaaaggaaatcacccattttccctcttgctataagaaaaaaaagggttgctctagatgtgaagggaggccaacagcagttaacaatataaaaagcaaattaattagagaaatagttctagtgcttaaaagataccccttcacagtaattgccttggggtacaagtacacagttaacaactttcctaagaaacctgaaagcataaaaagagccaggaaccccctcaac

SEQ ID NO: 20484 - DNA, 4968 bp, Homo sapiens
ctgctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaattcaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggta

SEQ ID NO: 20485 - DNA, 4400 bp, Homo sapiens
agcctgcctttgtggtctgcacgctgggaaagcctgacacctactggaatagaaacagtttacaacgcccggaatatgctcaagtcacagttttgcaaggaagggggaaacaaaaaataaaattaggaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaattcaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggta

SEQ ID NO: 20486 - DNA, 1234 bp, Homo sapiens
ctgctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtaaaaatgaaataaaataaaatattcattcagt

SEQ ID NO: 20487 - DNA, 1098 bp, Homo sapiens
ctgctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccaggtcatagattgtaattactatcatctctgacccaattattgtcaatgctatttattacaacttccaagcaag

SEQ ID NO: 20488 - DNA, 518 bp, Homo sapiens
aagacagctgtccaatgatctccaagatctcaccaataaaatgataaaagtttattgaggagcataaaaggaagtctgagtaaatgctatgttattgctatgttaatgggtaggaagacttgtatcaggtaaagtacttctacccaaacttacagattcagttcaattccagtcacttacataataatgagaaaacttattcttaaaatggacatctcaataaagctgttaaaaattaatatgaactagtcaaggctcaagaatggtaaagactaattgaagatatatgaaggactcatacaactaccacaattttttagaaaggtaaagtaattaaaacactacattagtatcataaggtgatatagtaattcaaaagattgataaatttacctttattaaaattagagtatcttattaggaaaagacctcatcaagaataaagctccaaactggaaaaagaaatttgcatatttgcaatgcatactccaagatcagattaatatccagaagatatt

SEQ ID NO: 20489 - DNA, 351 bp, Homo sapiens
ctgggtctgtcacctgctttgtaaaatgcactgcacttctcttcatgtcactctgaaaccagccatgacttgagcccatattttgggcttcacgtcagtggcatgtttgacacttgacgtacaaaccctggcgcaaagcccattccacgccaccaaagcggcagcctgttgtagacttcgccggtgtgttcgtgtttatatttggttctttgcttgctcactcaagagctggatgttcgaaaaagtcttccttctctatattttagagtgggagtaaaatgtggatgggtgggcttccctccaaatacatacttttaatgtcttttaaaataaaattaagtgtctgatttt

SEQ ID NO: 20490 - DNA, 465 bp, Homo sapiens
gtcgaccgattctactgcctcagcctcccgagtagctgggattacaggtgcccaccaccacgcctggctaatttttgtatttttaatagagacgagtttcaccatgttggccaggctgttcttgatctgctgacctcgtgatctgcctgccttggcctcccaaagtgctgggattacaggcgtgaccactgcagccagccagaaattgcttcttctgaatgttaccatgtaagaaattctcttgagtaattcagaccttaaagatatgtacctatgacttgggcaaagttgttttctagcttgttcttctccctctgatttggatatagtgcaaggggatgagctttattttaataagctgatattttccaattgtatgtctagagtccaggccattaaatatattttcacaagtaaattttccatgtggtgagattcttattagaagacatattgctgatggtt

SEQ ID NO: 20491 - DNA, 147 bp, Homo sapiens
aaagcgtaggtacgttcttcaaatacactgtttttacaagtgccaggtaaggttctcaatgtacaagaccgaagttgtgtcttctttcagtttatataactttgatctgctatgtcagttttacccagggagctttgtttaaaaaaa

SEQ ID NO: 20492 - DNA, 3689 bp, Homo sapiens
agacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtctcattgctcatatagaagacccagaggacactaaccaaggatgaatccctagaagtggaattgctgggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcttgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctctttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtactgggtagaatctggagttttcatctcttttcaaagctgcatatctctcatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtga

SEQ ID NO: 20493 - DNA, 4008 bp, Homo sapiens
agacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtctcattgctcatatagaagacccagaggacactaaccaaggatgaatccctagaagtggaattgctgggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcttgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctctttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtactgggtagaatctggagttttcatctcttttcaaagctgcatatctctcatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgaaaaaaaaaaaaaacaaaagaaaaagacagaaagaagaaaaagacagacaacaaaaacaagaaagacacaaacaacaaaggagaggacgaagaaaaaaaacataaacgggagaacaacaagggagaaacaagagaaaagaaaaaggcgagaacgagaagcaaagaaacaaagaagcaacaacagcgaagcacagggaagagaaaagaccagacgagatcagaggaagacagaagacaaaacaaagaaacaaagaagaacaggacagaaaagagagaaggaagacgaaagacgaagaaaaaacagaagacaaaaagacgca

SEQ ID NO: 20494 - DNA, 450 bp, Homo sapiens
actcactcactatcatgagaacagcatggggtaggggtaaaccacccccacgatccaatcacctcccaccaggttcctccccaacccctggggcttccaattcaagataagatttgggtggggacacagagcctaatcatataataggggcatgtcttatatttacatgtgcatgtgtgtgaatacagaggaagatgccagtgtggacacagacccagtggatagctgagatgatctttggagacaggagtagggttgtgacaactaagaaaaactttcactttttactgcaaatacttctaattgtttatttcatatatatactgtttatttataaatagataaaatatttattttatataaacagactgtaataatttacttgattgccaaagaaaatccatgtaacatttatgtaacaaaataaactgaaaaatttaatgatttatc

SEQ ID NO: 20495 - DNA, 452 bp, Homo sapiens
ctcctatctgtgagactctgattctgtggtgctgggatggagcccagaaatttatattttcagaaagtatcccaggtaattcttaacttacagaagtttaggaaacagccatatggaacataataaacttttgatgatttttctgaaaatgactatttttttttttttttttgcctttctctggtacaagtctaatagtgcagtttactcacctactggctgtgagaggcccctgttttccccgccttggctcactgggcctgtccatccagggaaaatggaccacaaataaggacagtctcccgcagaagtcccccttaaatttagcctgattcctgatggccccagggcagcatggctctccatgagaccccaccaggctgctggtcccaccggaagcccaggctgcaggcctggcccatttcatgcaggtctgccagccgctgtgtgcc

SEQ ID NO: 20496 - DNA, 372 bp, Homo sapiens
gtttggtgccaggtttctgatggagaatttgaagatacgtgtttacatttctataaagtaaatttgactgtctgagtcacatatatcttggtcataattcacaattattaggaaatttgaaaataatttttttaacaaaagcaaatttgagaaagtctatttttaaagttgctaaaataaggggctcagtatatttttagtaattggaagactggttgattgagaaatacaaatttttcagtaaaaatgtattttctttccaaataaaataaaaatttatgaaatataatttctaaaaatttgacaattaagtataaatattctaactgggtattggcttataattaataaatgtaatttaaatatgtttta

SEQ ID NO: 20497 - DNA, 554 bp, Homo sapiens
gtgcctacctcacagtaatctaacctaattaactcgaaattaatacaagaaaaactgcttagaaccagaagcactcggacgttagctgctattgttgttttggaaagacaataattgtggagagcaattatttttgctgaatgccagacatggcagttggcatttttatgtgctttattcctcacaaagtttttccaaataagtactgttattcccattttcagttacagctaatagattgtgatatatgttataggttacccatgagattacacaggtagtagattacattcagtagcctcaatatgagaaatctaaagaaatattttagaaagagttttgttttagtacttttttttttttttgagatgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagtctgggcgcaagaccaagacttaaacgcaaaa

SEQ ID NO: 20498 - DNA, 357 bp, Homo sapiens
  misc_feature (6)..(6): n is a, c, g, or t
  misc_feature (29)..(29): n is a, c, g, or t
  misc_feature (34)..(34): n is a, c, g, or t
  misc_feature (38)..(38): n is a, c, g, or t
  misc_feature (41)..(41): n is a, c, g, or t
  misc_feature (43)..(43): n is a, c, g, or t
gaggcngcctactactactaaattagcgnccgtncganttnantctaacccaatattgtagtagttttgtttccttttattgatattgagaattttagagagaaaaagggcattagaatcatggtgtctggctggacacagtggctcacgcctgtaatcccaacactttgggaggccgaggcaggtggatcacttgagcccaggagttcaagaccagcctgggcaacatggcaaagccctgtctctacgaaaaatgcggaatttagctggacatggcggcacacacctatagcccccactacttgggaggctgtggtgggaggatcacttgagcctgggaggttgaggctgcattga

SEQ ID NO: 20499 - DNA, 159 bp, Homo sapiens
gcggagctcgcagtgagctgatatcgcgccactgcactccagcctgggcgacaaagcgagactccgtctcaaaaacaaaaacaaaaaatctagcaatattattggtataatgcaaactctctttatgtgcaaataatgtgattatgctcttagaaaagc

SEQ ID NO: 20500 - DNA, 343 bp, Homo sapiens
atgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatt

SEQ ID NO: 20501 - DNA, 358 bp, Homo sapiens
tgcatctttcatgatcctgtgggaagctttctcctttctttagcttccttaactcactggctcctctttctctttcctgccctgaaacacagtccttaccccccattcttcttctttattcatttgcacagttttaatcattgtttctaaattagcaatttctaaaacaggctcatatttataattttctataggactataataatttaactcatcagaaactgaaaatagtttcaatcaagttttcttcctactccttccctgtcagttacatctttcttccctcagttctccagatttatactttgcagtctttcttcagccaactctaatcagccatcaaatcctgtcaattact

SEQ ID NO: 20502 - DNA, 269 bp, Homo sapiens
attactgggcaccttgctatgtgctacctcaaacgagtcgattcgccaaatactccaggaccccgtcatgtgaactggccgatagcaaaacacatccctgaatgtagtggagctgtttgatgtgagaccactttcagacatggaaatgccacaaggaggagagaagggtcctgtcctcataaagcttgattctaggcctttcactattcaaacaaggaagagttacttcctacccctccaagggtcaaatgagacctgcacctggggtg

SEQ ID NO: 20503 - DNA, 666 bp, Homo sapiens
ctacagcctgcagaacgcgcagggcctgggcatggggaagcacggatgaggagcctgctgctgatgctgagcaggagccgtggaggggtctacaccactctgctgactctgcgtgatgaggattcaaaatgccattcacgcaaaacaaatttagcaactaagaagtagagcggcgcgctgctttagaagcactatgtgttagcaggtgtggtacacacctgactttgcttctgtggctgaggaaggggaatgagtcttctgtgcgtaaatctttccacaagcaccatcctgggtgtcctgcctgaccagacttgtgagccagggccaggttgaagcatgtgcccaggtgaaaattatgcattatttattcatgtgagcaactctgcgcctattttgaaacattcactgctttgttttgtttgttttgtctaattgcatgaaagatgtggtaggcagaataatgccccccaacaaaaggtgtccacttcttaatccctgggaacctgtgaatatgttaccttactagcaaaagggactttacagatatgactaaggctaaggaccttgagttgcaggaaattatcctggggaccatccagggcaggcctggagacatgagtcctctaaaaacagagactctttcccagctgtgctcagaaccagagg

SEQ ID NO: 20504 - DNA, 1100 bp, Homo sapiens
ctggaaaacctgaatttagaaaatatgatagtgactctgacagatgtttattttccaaaatggattatttctttaggatgtgatatcctgtgattttattccctaggatattttcatgatattgatagtcattttgaaaatagaggataatgcttgaacttgaacaaggtaggaagcaggaaggtatgtctgtctccttctttcaaaacaatcttccatttaaatatttgttctgtaaatgaaaattcaataaaaccttaacagtttggaattcttccaggaaaaaacaggctaaatataatggaaagtctgaataaattaatattgagaaagaactatagtttgcttttaaataattcagatgtttgtgtgcaaagtgtttctaagttgacatactcagttcccgttaaaataaaattctgaattcgtcatagctgagatatttgcttagtggtaatgttttaattttaagaatttgtttaatttttttaaaatacatttcaactaagcatgcccctgaaaactttttcatatagtattctgaagatttccatttaaaatatgggggaaatgaatttcaacccattttataggagtgtcaattagttcctaaaaaattaatgaaggagtatgaaggagtactataaaaaaatagacactagacaaaattggagattaagagaggctgaagcataactgatttgcaggatattggttttgataatagaaggataaggatgatctatagttgataaatgaggctcattaagtaagagatgataaatgcagatattcctggctaatagaaaagtcagcatacaaattttgccataacaagtgagggatgggcaggctttgaccagcttgcagctcttccagtgacctctgtgaggccacggagctcttctgtggtctggatgcctgggccacagaggcagcgtggaccccatgggcctcaggccagcagaagggggagccagagtgggtctcagggagtctagagccacctagagcagagcttacaaggagctccacaatggtgcagaggccagggcaggactgcagctcctgcaagtgtaactttttattttttatgctaa

SEQ ID NO: 20505 - DNA, 587 bp, Homo sapiens
cagtagagctggggtccgagccaggtctctgactctgcagcctacccttgtcctgcttgaacacactgaggaagacaggaataacaggacatgggtcagaaggcttggcttctgctccagctttgaagttgaaggattaggtgacagctaacacttgatagtattttatggtttcaaagtgataaccatgtaatattttaattgattctcagcccattttgtagatgaggaaactgaggctcacagatctgatgacttcctaattgtggcaaactaccagctacacagtagctgggctggcttcgaaccaggtcttttgaccccagagtctgtgcagctcacaaataaagctgattctttgacaagttaagcctcttctcttggattcatttttccagtctgtgaaaatgagggattggattagattagtaggcaatcactagttcccaggcccttttatttaaagaaaaaaaggagaacccatagagtctggcaacttaaacttttgctaagtatgaacacttaaaaaaaaaaagaacattttgtcttcaaaaagctagggggatattatctcagtgtagtgggga

SEQ ID NO: 20506 - DNA, 302 bp, Homo sapiens
acaagatgcgcacggcctcagaggcctccaggaggaattgggctttgaccctgaggaaggtgggagccatggagggctgtgggtagaggaaggccctgactcaggtactcacagacatgctcagctgctgtggggagggcagactgtgggggatgactaggctggggctggactgggtagaggatgagggagaaaggcacattctaggcagacccaatagaattttctaaacggctcatttggggatgtacagaaaagaggggactcaaggatgacttctgggtttttggcctgagcaccct

SEQ ID NO: 20507 - DNA, 453 bp, Homo sapiens
gcaaaaacatattactttgaccacaattcacattccgtaggaggagacaggattagaacatttctattcttgcccaatgctgctaaatttaaagtcaatttaactgttcactgcagtcttccttcaaaagaccaaaagcaagcctcattttctggtggcaaaatgctctggaacatcatcatgagctgtgttgttgcgcaaaggaagatggcaggtcacaaaaaacagtcttaagctcacagccaaggctgctgctaaataccaccacttatgcctttattcttactctcatccatttatgtctgagtgtatgtatttagacaataatttcctaagcttgcattatactagaatatgaaggtgaatgaggcacagtcccagcccttgaaaggcaaacagacagtctaataaagacgggcacacacataaacaaatagagaaaattctccatca

SEQ ID NO: 20508 - DNA, 410 bp, Homo sapiens
attcaatggctttatgtcactgacaaattttcattttggacaacatgctagtgtgagtagtttctggtccagtgaaatccagttttcagatattcctatttttggattctcagctgtgtatttgaaatcatcacatttgaaatttgtttgttccagaacatatatgttctcattcttgtttgtacttgagtcatgtttaatcacatatatctgtagtatgcttagatgtagtagtttccattttcataactacttttctgttgatccattatggtgaattgcagctacaaagtcatactgtgtagtagcgaaaatgctaacataaggaggtaaatagtaggcaggcaaagggattttttaaaatatcccaaccctagtcatatatacccgtttagctcagtagttctcag

SEQ ID NO: 20509 - DNA, 447 bp, Homo sapiens
gtgaaggggccctgtcccacccatgttggcccccagcccacactgcccgtctgccagcgtgagcagcagcgcgaggcctaccagcaggtgagaaagggtatgcagacgagagggatcatcccaggaggctgcagagatgaaaataaagaatcaggcatcacagcgtaagaagtaatattgttacagtgcatgacacaagatctagaaacaagagagtcacagaaacctaacaaagatgagaactttagaatgtaaatgtaataaaagataggaaaatgagatgcaggataaggagataaaaggtgagaagccaacgagctgccaagcagaaggctggaaacacaaaagagcgaagattaagaacaagggtgaagctcatcgccacgaggtaattttttaagtagatgaaaccataggtcaaaaatgagaattaagggctagggagtt

SEQ ID NO: 20510 - DNA, 460 bp, Homo sapiens
taaaatcccaacacacaatgaacttcctattggtgtgctctggcctctgaaaagtaattgactcaatggtaattggcctttagtgacaatgtactttaatgatagtggcttatgtgacctgcaaatgttaaagtcccatgtcttgctgagttcctttgtgatagtgagtgatatagtttggttgtatccccacccaaaatatcatcttgaattgtaatccacataatccccataatcaccatttgtcaaggggaccagggtggaggtaattgggatcatggggggtggttcccccatggctgttctcgtgataatgatttttcatgaggatctgatgggttatataaatcatctgggtacttcacttccatcctgtcaccctgtggaaaaagggtgcctgctttctcctttgccttctgccatggattataagtataaacctctttcctttataaattac

SEQ ID NO: 20511 - DNA, 359 bp, Homo sapiens
aaagctctccttgatggtactgtgccacaaggattgagaatctcagattataaaactacctttccgtctattcaaatagttggtaatttgactattaaaaaccacttactctggccaggtgcagtggctcacacctgtgatccacccgccttggcctcccagattgctgggattacaggcatgagctaccgcacctggcaataaattgcttttgattttttttattttgctttttcctggagtatattaaagcagtctttgacatagtgtttcacacattaaaaagtcagcattttagcatatatctctgaaagataagtgctattccagtgacaatgccaatatcacacctaataaaa

SEQ ID NO: 20512 - DNA, 320 bp, Homo sapiens
gcacaatggctgttaaatagaaaagagaactgtaatttattttaagattcagggattttgtatttgcaaataggcagcaattatgaaatgaatactgtaattataaccactctggaaagatgaatgaggtggtaactagctgagatgtgttttctggttagaaaatatattatctcagttctgagcaaaatctgctgggcttcctgtccctgggtttttgggcgctgaatcagagagtgattaaaagcctgggaaagctccctctccccctgatttgctgagggagcaatgctgccctttctcagatgagcggggtgttc

SEQ ID NO: 20513 - DNA, 488 bp, Homo sapiens
cagcccagaggcacaggaccactaagcacacagttatgtgtaaaattatagaatgcctgactttccccatatcttagcatcacaccaacaggggttcagtataacgacagtgtattacaatggaaagaactgtaaaatgcagagtctctgaagaagagtcttaaggaagcccaaagtcaacaatgaagataaaaacaaggacactagagaaatttgagtcctgtggcacctacagttacagcaaacattcatacaacatgtctggggtttaaaaaattataaagcatgccagaagtcaagaaaaacacaatctgaagggggaaagtaagaatcagactcagaccttgatataacacagatgttggaattatcagacaggaaacttaagatgactatgattaacatgttaaaggtcctaatggaaagaataggcaacatacaaaaacagatgggtaatgtaatctgagagataaaaacaacaaaaataa

SEQ ID NO: 20514 - DNA, 268 bp, Homo sapiens
aggcggtggttgtggtgagctgagatcacactactgcactccagcctgggcgacagagcgagattctgcctaaaaaaaactaatactaaaatatttacttttatgtataactaaaataattcatccaaataacagccaaaatcagtctcaatttttcctaggtagcactgcattttggttcttaactgagtctttaagcatcaacctaagtggttggaattggctacatctatagagggtttatcaactgcctgccaaggagcttcca

SEQ ID NO: 20515 - DNA, 522 bp, Homo sapiens
aatgaaaactaagataagcttagaacaagtttaattagtttaaaatgaaaagctagatgggcctagaagaggaaatcatgctaatttgctaggtgtttgcataaagtcactaaatgtatttgcatatcagatgaacgaaaaattgctaaaagatacacattgtctgagtctgttcttcttaagcagatcatacaattaaaaattacatagaagaagatagaaaaagtagcttgtcttggctgggcgtggtgattcacgcctgtaatcccagcactttgggaggctgaggcagttggatcacgaggtcaggagatcgagaccatcctggctaacacacggtgaaaccccgtctctactaaaaatacaaaaaaattagccaggcgtggtggcgggcgcctgtagtcccagctacttgggaggctgaggcaggagaatggcatgaacctgggaggcagagcttgcagtgagccgagatttgccactgcactccagcctgggcaacagagcaagactccgtctgga

SEQ ID NO: 20516 - DNA, 431 bp, Homo sapiens
agaactcacagttctgaaataccaaattgaaaccttttagttgtttgcagatcattttgccatgttttctcagttcagcatgcacacaagctaatctttggaatttttacttggaaattttccggcctgttgggttctggtatgctttcctgaaaatgtgtttttgtgcttatgcttattgcagtaaactagaactattcatttcaagcatttgtaccattctttggtgggacttctatagacaaccccgtgttgactgaaattatttttagttctaagtataaaaaccttaaaagtagataatccatcacttttcatcttataaaactgaacagtacacccattaaaccctattctcccctccccccagcccctagcaaccacaattctactttctgcctctctgattttgactactctagatacttcat

SEQ ID NO: 20517 - DNA, 1004 bp, Homo sapiens
cccgccgggtcaggttctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaaactcaaccttcctgagtccacacatgttgaatttgtaatgttctcgacgacgtgtcacactgtgttaaagacagacttccgaagtgtgtttctgcatttgcaaatactgaaggaggatatgtattttttggtgtgcatgatgagacttgtcaagtgattggatgtgaaaaaaaaaaagcttattacggcggtatcatgacttttgcatgggcgacagataacgacgccttacgccatctctcaaccgaaattattcaggcgcgttttctcgcctctggcctgaaatgccgttattacaatccggcaatccatacggca

SEQ ID NO: 20518 - DNA, 1003 bp, Homo sapiens
aagagtaggcatagtacgaggcccgcgtgttataggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaaactcaaccttcctgagtccacacatgttgaatttgtaatgttctcgacgacgtgtcacactgtgttaaagacagacttccgaagtgtgtttctgcatttgcaaatactgaaggaggatatgtattttttggtgtgcatgatgagacttgtcaagtgattggatgtgaaaaaaaaaaagcttattacggcggtatcatgacttttgcatgggcgacagataacgacgccttacgccatctctcaaccgaaattattcaggcgcgttttctcgcctctggcctgaaatgccgttattacaatccggcaatccatacggca

SEQ ID NO: 20519 - DNA, 923 bp, Homo sapiens
aagagtaggcatagtacgaggcccgcgtgttataggctccgttgcctgctcccggagggagacgcgctgccgaggagaacccagcgggtaatgaatcccccgcgcttctttgcccaggccttccccaaacctccccccggtctgcgcgggttctcctattgggctgtggtgaagacaaggtgcggcgactgcagctccccaggtctgggcgctgccgggagagagtctttcccgctggggagatttagtttgttgactcaggagcacctccaacgacagctagtggcagaggacccgggagctgggaggttcggaacgcggggcgagctggggaggagggagaggcgccgacccagcgcagcctacatcttagcaaaccaaacctggcaacatttccccacggttcaggagcacgaaggacttaagggaaaacgacgaaatcggggctcccgaggatgaagttaaatgggttgtggcctggggacaaatagggccaatgtccagtctattacaagaggctttgttccagaggcttgcctataagcccctggcttggaacgtcagtcttcaaactgtaacaacaggggcaggctactagggtagcccacaaagccctgtatcccccatacagtgactaactagagccctagttggtcatatccgcagtggctgagactgcggtgtgattccgtttccctcttgcatgtgtcccgggagcccgagttgtcgaagcccaaattcaggctcaggaacctgatgtgctgttgatgccaaaacactgacacacagatgcttggagacagaggaagatttattccatttgggcaaagcgagaaggcaagaggtcaagatctctcaaatccaccctaacaaaaagaagtagtggggagtttttatgagaccaggaagtaagggagggggaa

SEQ ID NO: 20520 - DNA, 497 bp, Homo sapiens
tgcagtgcagggactctgtctgctgcctggcacagaatggttgcccaaacatacttcttgaggtaaacggaatggcagtcaatacaaaaactcaccctcactctgcacaccaccatagccactgctggctagcaggcaccctagccaggctaggagataacatggtggctggcagcagcttgggctttgaccggaccagtggttagtagcgtgggagagcatcctgagtctaggatggggcagggactggagcaaggcacctggattccagaaatttgggggtaaaccaaggcagacccaccgccccagtgcacttctgctttctatctccagtctcatggctccctggacccccaaaagttatgaaaactaaaccagagctgagaactgggctaggatggaattgcctgtcaacccgagggatgcaaagaggaaccaccgttgggtccattaagaaatccacaaataaaataaaaataaatcagtgtgacacagac

SEQ ID NO: 20521 - DNA, 1139 bp, Homo sapiens
ggtgtgttggatgccacctgtgcccctccctggagatgcttttggccccacagcttcctccagccaatgtagcagtgactgggtctgtgcaggttttggtcaccttcactcaggtgtgatggggtggtgcctttctttggcctgccccaggtatcttttactttttgggatgtatttgatgctatagtatggaatgctgcagagacttccggcaccaaccccctggagttggactttatttcacaggttgagggcaccatcctccacaagaatccccaacttcagccaccagctggcaacaggtttgggggtcctcagcccaccctcacttctggccagatggctacaaatttggcgatttccactaccccctcaggtttgatcacttgtcagaatgattcacagaattcagggacatgctatgcttacaactacagttttattaattgatcaataaagcaaaaggatataaatgaaccagtcaaagggaaagacacatagatctgggaggacaccaaacgcaaagctttcattgttctctccccgtggagtcaggggctgttacctttccagcacatcgatgcgtgacaatgtatagagtattgccaaccagggacgtgctcctgagcttcagtatttgtcatttttattggggcttccttgcataggtacgattgattgaatcattggccatgtgactcaaactttagcaccctcatttccccagaggtgatcttgttagcatccactatctaggggcccactctgagtcaccttgttagcatcaacttagaggtgtgggcccgctatgataacaaagatactgctgatcgggcgcggtggctcacgcctgtaatcccagcactttgggaggccgaggcgggcggatcacaaggtcaggagatcgaaaccatcctggctaacatggtgaaaccttgtctctactgaaaatacaaaaaattagccgggtacggtagcgggcgcctgtagtcccagctgctcgggaggctgaggcaggagaatggtgcaaacccgagaggcggagcttgcagtgagccaagatcgcgccactgcactccagcctggcggacagagccagactccgtctcaaaaaaaaaaaaaaaaaaaaaaaaaaaaga

SEQ ID NO: 20522 - DNA, 4028 bp, Homo sapiens
cctactaaaaaaaatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttagaaaaaaaaaatgtaatgaatgttggcacacacacataaaacctgctacatagggaatagagcccctttccagtagagtttaaattgcaaagggtactggggaagatgacgattaagttgcatctttagagtcagggtagatttggaggaaaagtgcatcaaatgagagcttctgatttgaaagccccagatgacagaaagcatatgtggatgctcagttctgttcaagctagacaacactcaccaaggagcaaggtgcaagtgtgttgatttcagaaggacatgaacctcgtgtgttgattccattctgctgttctcgagatttagttgctgtcaagtgcctggagtggtgctttattttttgtttgcctcacaattacattggtggcatgtgctaatataaagagctttaacttcaaacattattggactaaagagatgaacagttgtgttatgacagaaaaccagatttttgccattttaagagcaacagtattcctcaatcctgtctgttctgcagtattaagctaagaacaggtaaaacagggtaacggtaatctggaccttaatttctgcagttcatttcttttaatgttcttgtctgcaaaaactcaggaaagtgattgtgatttgtacagtacctcaaaggaatgtgttgaaagcactatgtactgctgagagtaataggataggcttcaatgttactttatattaaaatgtatgtttacctcaacaattggaaaatagcaaggaaaattactttgaatgtatccagaaaaatactgaagtgtgatacaactgaatatttacagtttaaagtagaaatggaaggatttttttaagttcttttactaattatggggaattaaccagagcagaataattctttatgtcaataactgcaagagttcttagtacattgctccttgataattaagtgaaaatgttcttaaaaggtacactggttaattgaaagctacttattcagtttgtgttagtgtctagacctgtcagccacaagacctgtttaggaccctgaaagtcacagtacctaaaaactatgactgcctttttattgcataggtggtagtggtggtgatggtggtggtagtttgcaagttatctcttaaaactgctgggaatggtgtcattctattcactaatctagcttatagacttgccgtgctgtttgatagaatgcagaggatagcaaccaaaacaaatacacaaataaataaaaacaaaaaccaaccaacaaaccaacttacatacacatatatatatccacaaagaacctctccatctcctccccttctttttgactccactcttgtcagtgcaattttgcttctcattttgaaatctgggctgtagtgctcctgctttatttctacctcagttttgttacatttctcttggaaagtaaagtagaaaattggaagtggacacacacactgcaatgtagcttgccaaacatgttactttgttttcttccatctttcaccgtaaatctagtttccaaagacatcagcatttgtgcttacttccacctcagtctaccagccccacccctacccatggcataagtggcatttttcttaatttcctatttttctcctgctctctgtcaagttgttctttgtatcctttaatgctttatgtgcaacctttcattgatagtgggctgatgtttggcaatgcttctgaactgtcacagagcaggctgtagctttccacagccactgcccatgcataagcagaacagcctggccttttgaatgtattttcctgggtttttttccccttttctttttttagtttagagatgcagtaacaaaactgttgcaaagcactggcattttatgtattcaataaataagtgatgtacatttttaaaaaaatttaaataaatgcaatgagaagccccaagaaagg

SEQ ID NO: 20523 - DNA, 434 bp, Homo sapiens
gggggacagagtgagtctccatctaaaaaaaaaaatagcatgttatggaatacttggttcaacaaagttaaacaagtttctttccccctggccttctcagggcctctgctgtgctgatgtacaccgtgatgctccaaaaaagatctaaagcgaatcatatttctcaaaccctctcaccagcagtggttctttgggagctaggggtatagtccacagcagtggaagaatggggccccaggtttcccatggtagtcttccatcagctacaactacagacccctcagttcgtctctcacacacaagtgggtcctttgcttaatagtaggaccattatgctcccatccccctccacagctgcgagatacttagtatagcagaatcaggagcctgcagatctccataggggtgaatatgctgagggtcttgctcatcta

SEQ ID NO: 20524 - DNA, 210 bp, Homo sapiens
cacgtcagacaggacttttattagtatctattgacctgatagggttgtcatggggacaaaaatgcatgtaaagtgtgtcccatagagtttggcacacaagaagcacttacaaatctctatgattgggaagacatagaaaataaagtttttaaaaatgtttcaagagaatgactttcactgaaaatatagaattcttataaatagtaacat

SEQ ID NO: 20525 - DNA, 789 bp, Homo sapiens
gatagatagactgtctcagatagatagatcgatcgatcgatagactgtctcagatagatagatagatataaatagatagatagataaattcatacattgtacctgagaaaagtgtcacagaatgaccaatactgagacatactttagtaaaattgctggattttaaagacaggaaagtcctttgagcatccaagcaaaaaaggtaaagtcatttataaggaaaagaaaataagaatatcatcagacttttcaacagaattttttgtgccaaaggaaaaaatagcttaagatactcaatgatctaaggaaatgtcaaccaaggatttttatatccagccaaactgacttccagatacaaagactggcacaggaaactttaacaactttaacaagaattcagtgactttttcagtccttcctgagagatctcctggaaaatgaatttcaaatgaccaaaaaccactccccgccccaaaaaaaacaaaacagagaaacactgatataaggactggcagtgagcactaaacatgtatttatttttagatttaaattcaaatgagggctctaggggagaaaatatttcatgtgtaacgtctgtaagacatgtcagtataaatacaatgcatctgttttaaaaaatgaatggacagtgggggagaacatatgcaaaatatttagctgttttcagtaatcataaaagtgatgagtaatcccagcactttgggaggctgaggtaggcggatcacaaggtcaggagactgagaccatcctggccaacatggtgaaacc

SEQ ID NO: 20526 - DNA, 429 bp, Homo sapiens
gattaattttttttttttagaaatggagtctcgctctgtcgcccaggttggagtgcaatggtgcagtcttggctcactgcaacctctgcctcctgggttcaagcgattctcctgcctcagcctcttgagtagctgggactacagtagcctaccaccacacccggctaatttttgtatttttagtagagacggggtttcgccatgttggccaggctggtctcaaactcctgacctcatgatctgcccacctcgacctcccaaagtgctgggattacaggcgtgaccactgcgcccagccgtttagtgatgaatttaaggtagatcctttctctcctgatatgtggcgtcctccagaagaactcagctaattaggggcagtcaaagaagaatgatagttgggtccttctaaggtggattttgtcagaccag

SEQ ID NO: 20527 - DNA, 393 bp, Homo sapiens
gctactactactaaattaacaacccgtcgaccaacagcagacagctcttggtgctccacagtgctgtaggggcgctgtgacacatgccgaagagcctctctcttctggaccaaggtactcaggccaggcatgatggttcacacctacaatcaaaaggcaggcggattgcttgagcccagcagttcaagaccagcctgggcaacatagtgagatcccatctctacaataagtcaattaaaaaaaaaaaagccaagcatggtgatatgtgcctgtaagtccacctactcaggaggctgaggtgggaggattcccgaagcccaggaggtcgaggctgcagtgagctgtaatggtgccattgcacttcaacctgggcaacagggtaagaccctgtcc

SEQ ID NO: 20528 - DNA, 256 bp, Homo sapiens
aggcgggagaactgcttgaacctgggaggcagaggttgcagtgagccgagatggcgccattgcactccagcctgggtgacagagcgagactctgtctcaaaacaaaacaaaacaaaaacctaaactaaactcagtgttgagggtgacaagagttctgaaaggcagacttgtcatttaattcccacctccacctctctctcgctgtcctccccaaagctaggaacacccagacccggctgaggccctctcgtaccca

SEQ ID NO: 20529 - DNA, 328 bp, Homo sapiens
tcatttctgttcactacctaataaatgagtaacaagaattcctctgccccatctcacaataccaaataatgatgtttactaaaataataacaatttggcctaataaaagagcctccaccaaagccacttggtgatcactctgccacccaagtttctgccctggcattctgacaatagtggggatggtaatacacttagtcaaaacatatatggagccgggcgcggtggctcacgcctgtaatcccagcactttgggaggctgaggtgggtggatcacttgaggtcaggagttcgagaccagcctggcaaacatagtgaaaccccgtct

SEQ ID NO: 20530 - DNA, 343 bp, Homo sapiens
gtgaacactaagttttttttgtctcttctataattgcctttgccactattttagagtttttattgtacaaatcttttaccgtcttagttataagtattatttttgatgttatggcatatggaattttcttaatttttcccatatattttgttgtaagtgtatagaaatgcaatttattgttttgtacattgatatagtatcctgcaacattgctgaattagtttattagttttaaaagtttttttcctgtaatgatgagcacacgggactgtgtttacacactcattaatattctgttaacatatcacagtgcctaaaaatgtgctctgttgtatttctgcgg

SEQ ID NO: 20531 - DNA, 705 bp, Homo sapiens
atttcatctattctggttgatgtgtaatagtgtcatattagcattttttctttgcttttataaaataaatgtttttatgttggaatgttagatttacagaaaagttacaaagacagtacagagttccttatatacccttcatccagtttcccccttatgttaatatcttaatgttaacatggtaactttgtcaaaactaagaaaccaacactgactggcacattactattaactaaactccaggtcttattcagatttcaccagttcgtgtgtgtgtgtgtgtatgtgtgtagttgtgcactttaaccaccaccataatatacagaattgttccgttgccacaaaggaacccttgtactacccacttattgtcacaccttatcacccatcctttcaccaccttccctaacccctggaaatcactaatcttcactgtaattttgtcatttcaagaagttatgaatggcataatatatgtgatacaaacatagcatatgttaactttttgagaatgggtttcccctccacagtatgatgctcttgaattccatccaagttttattatatgtaccgatagtttttcgttttttaacagattgctgtggatgtaccagtttgtctgactgctcactcatctattgtaggacattgggttgtttctagttttgggctattaaaaataaagctgctatgaacatttgtgta

SEQ ID NO: 20532 - DNA, 233 bp, Homo sapiens
gagtctggcatagcttacctctactcagggtctctcacaagttagtcaatgctgaggtctcatccaaagactcacatggggcaggatctgcttccaaaatcacttatgtggttgttggtaggattcagctccttgtgaactgtagggttgagggcttcagctcctcactggctgctggatggaagcttccctcagtttgtgggcctctccaatatggcagctcacaacatgga

SEQ ID NO: 20533 - DNA, 397 bp, Homo sapiens
cttattgaaagtaataatacagttttattttttccactttataactgcccaagggtcccccaaccagctatatataagaaaaccataacatgaactagggtctttctattcaaaaaagaaatattaaactaacataagcaattctgaaggaagacagtggtaggttttcagatggtttgttaagaattatatgtaaaaggatactagatattatgttttggatgttttctaagtatctatgaaaattattttttcctaaacgatttcataattgattacttttgacctcagttattttggggcataatccttttactactctataaagaagttctacttctacctatatgaatttgtattttcccatatgccaaacacacacacataaattttcttt

SEQ ID NO: 20534 - DNA, 713 bp, Homo sapiens
atatatgctatatttattttgttgttaaacataccttaagtttactcagaattttcaatttgctatacaattatcaattagcatatgggaatatattactttaagatgacttgttttcttttgaaaatacatatgtgctgagggatatgatttatatccctcagaaattgacattgtaagttcttggataagttcttgcaccacagttgaatgaattttcaatggaaaatgtaatttaaagacttattttttcatctgttactcaggtttagaaatgtatgttttaagatctacttgccagtttctctttttgatccaaacatatgatctgcctcgataaataacaacatctggtaccaagaaaaagaaagaaagaaaaaagatgaagagtaaacctatggcactatgtaaagtgaacatactttgttgttacgaaatagaaataatagatcaggcatgtctggggagtattccctttgcataacaaacacaattagtaaacaggtatagcaacaaaaagaatttacataatggttaacagggatcaagaaagtgactttcctgaaagagttatttattcctgatgacattgatacctggtagtgttcgctgccaacctatcttaagggtaaagaattctgctggtgagtgtcatctgagcaaccatttaaaaatccgaatcattttagatttcttagtggggcaacaaggat

SEQ ID NO: 20535 - DNA, 396 bp, Homo sapiens
gcttttcttttgagtcaaggtatggctctgtggcccaggctggagtgcagtggcatgatctcggctcactgcaacctccacctcccgggctaaagccatcctcccacctcagcctccccaagtattaatagctgagactagaggcatgcaccaccgcacccggctaatttttgtattttttgtaaagacacagtttcaccatgttgcccagggtggtctcgaacttgtgagctcaagtgatttgcctgcctcagcctcccaaagtgttgggattacaggtgtgagccactgcgcccagcctgagaatttgtatttctgtcaggttcccaggcagtgctgatgtcgctggtcccaggaccaacactttgagaaccacgcctgagccctgccatgttc

SEQ ID NO: 20536 - DNA, 1031 bp, Homo sapiens
ctcgagctcctgatctcgtgatccacccaccttggtctcccaaagtgctgggattacaggtgtgagccaccgtgcccggcaatttttgtatttttagtagagacagggtttcaccatattggtcaggctggtttcaaactcacgacctcaggtgatccgcctgccttggcctcccaaagtggtaggattacaggcgtgagcacgggcacccagcccttaaatggcttttatgaggtaatgtgaaaggaaaatttgcctttgacctggaagtcaactttatagtaagctgaaattataaataactgatcatggaactattgcagatcacctttgagccaaaaatttggcctggattttggttatgcctactactatgtgcctctcatttgtatttatacctggaattggcattattaactccttttcactcctgcctagaaaacttaaagtgtcaccagacccaagggcggagtggtcctataaaacaaactcgtagcctgtctgaagactagctactagctccttggctgttttggcatattcatcttgattatagctcttggtctttcatcatattagggatgtttatgatgttattaaagaaaatcttgtcaaatgcagtctgttcctagttatctactatcagtcacctgttgtataattataacaatgtttggatttgtggattattattttagtatataacattggattttatgtatgttacctgaagaagagcaatatctgtaccacatatttctttgtttttcttttttgagatgaagtctcactctgttgcccaggctggagtgcagtggtgtgatcttgacacactgcaacctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggct

SEQ ID NO: 20537 - DNA, 414 bp, Homo sapiens
ggaagtccgagcaaggttgtggctgattccatttctcatgggggctgatttccttctccctgtgccctcatgtggcaaagaaagagtgagctggctctctggtgcctcttcttataaggacacgaatcctatcgtggggccccaccctcatgacctcacctaaacctaaacacccctaaaaggtcccaatccaaatgccatccccttggggattagagctctgacatatgaatttgggagagttgggaggggacacacaatttagtccatagcgaccccaacagcaagtttaggagatatgtttcaggtcaggagtattaagtagttttctcagtttaccgtaatgcttctgttatctgtagttctgcaatattttgctttcaacacacggcctgctgtcatccttcagatgta

SEQ ID NO: 20538 - DNA, 325 bp, Homo sapiens
gattcctaaagaaacagaatgctccagatcagtttcctgtatttttgtctatctaatctaagagtcacaggtactgtttcctgcatttaacagtgtcagacatgtagtgccaaacccaggaatcttgctggcgttaggtttttgatttcaaaattaaggaacagattctatggcttacatttgtataagaagtttagaatatctttatttttcttacattttctaatatgtaatcattgtgctggttcttgtctccttgaatgaatgcagggcaataaatctgtttcagatgttacaaacttgaaaacctgtagataatcctcta

SEQ ID NO: 20539 - DNA, 514 bp, Homo sapiens
tttgttatttttgttttgttttattgtcttttgtattttcttttagtttgtgtttatatagttttcttgaggtatcactgacatacagtaaattgtacaaatttaaattataccatctgaaagttttgacatatttatacaaaactgtgaaccactggcacaattaagaaaataaacgtatcaataatccaaaagtacattgtattaattcattatcctaaatatttgactgtttttttttctggtctaattttttaaatagtcatctccatctggattcttttccttcttcttgacttcattttatgctcagtgttttcacatacatttttagctgagcaaagttcctccatgaggcattccactcaaactcatttttccttgacagtgggtgggtcagtctcataaattacttcttttacgccagagcatctgaacatctgaacattgatctgagataactggtagattttagcattttgatttattttctaaagagagagtgcacagttaa

SEQ ID NO: 20540 - DNA, 364 bp, Homo sapiens
acctgtgatctggtaccatactccagcccgggcaacagaatgcaaccctgtctcaaaaaataaatagaaaataaaataaaataaaaataaaataaaataaaataaaaacaaagtttgttatgccacctaccagagaaacagaaaggctaaaagtaaaagaatgggaaataatactcaatgtaaacatataccaaaaggtagtataactatattaaaatcagcaagagcaaagaaaaagcattaccaagccaggcatggtggctcacacctctaatcccagcactctgggagaccgagacaggtagatcacttaggtcaggagttcaagaccagactggccaacatgatgaaaccctgtctccac

SEQ ID NO: 20541 - DNA, 162 bp, Homo sapiens
caggttgcatggagcgtggcatacaattggtgctacataaatgatagctgaacaattgtgctgccataaggcctcatacctccttctaatatagtatgtgaaggattgcactctagtaagttctgtactatctgtctttgcccctagaatgtgagcctggaa

SEQ ID NO: 20542 - DNA, 422 bp, Homo sapiens
aagatttattgtccccaacccagagacattgccccctttagaagaggtgtgcaccatgtgctctctcacttgcccaccctactctttgtccacttcattaatgtacgttacttgcctgtttcttacaagctatttgaggtttggttttgtttacgtgttccttaaaggacagtgggaacagactttgttagaaggagtcagcaatggcctggattggtggtgatctttctgaggaaatctttgtccaagtgaggcaagggattgactgtttcccaggaccctttcggtgtgatagaaatagcagctagttgataccccataggttgttttttttttttttttttttttttttttttttttttttttttttttttttttttttttttttttttttttttttttttttttttctattatatttt

SEQ ID NO: 20543 - DNA, 540 bp, Homo sapiens
aagatttattgtccccaacccagagacattgccccctttagaagaggtgtgcaccatgtgctctctcacttgcccaccctactctttgtccacttcattaatgtacgttacttgcctgtttcttacaagctatttgaggtttggttttgtttacgtgttccttaaaggacagtgggaacagactttgttagaaggagtcagcaatggcctggattggtggtgatctttctgaggaaatctttgtccaagtgaggcaagggattgactgtttcccaggaccctttcggtgtgatagaaatagcagctagttgataccccataggttgttttttttttttttttaaaaaagaaaagaaatagcagctagccttggtagatggcagaggaatggggctgggagagattaagtgtttatctggcctttctggaaggaatgaactttggtctggattcttggtatagtagtaaaaaattaagttagcagtgtctagtttagatccaatatttctatttgttttatcattaaaatatagaagttta

SEQ ID NO: 20544 - DNA, 550 bp, Homo sapiens
caaaaggaaacatccttagcagtgtgagtgtgcacagttcctcagctttaaagttttcttttgagaatgaatgctgcttaggtgactgtggagggcagttcatgaacgactctggatgctgtggctccagtttgtacgtacttctaaacccttgaaaatggttttttccttagaaataaaatttatgtaaaaagttatttctgaaattctattttttctctatgtatatatttacaggcaaaataaagtcaagtcacttctcacggagtcctgagctgcaccgtgctctccgcagggctctttgtctgagggccaccccccactccacaccaggggtgcctagactagggggaggcctgctctttggtcctgtgacttgttgcccatactggtgcttcctccatggagggtctgcaaagtcacgtgcaatggaaagttgccctgcagatgctatagccaccagtctccacctcttcatgggaaagagacttggggctatgcattgtcacttgatcttttgtgattaggtcacattcctgtgttatcactg

SEQ ID NO: 20545 - DNA, 378 bp, Homo sapiens
ttgcttgattgccaaggatggagtgcagtggcacgatcatagctcactgtaacctcaaactcctgggctcaagtgatcctcctgcctcagcctccctaatgaggctttacccttttaatcctgtcaccacaatcatttcttaatgcttcaaacatccatattaagaataatacacaggcagggatgcaggcaagtagaggagatagaagtcacagtgtttgagatccacagggtgatgatatgttgttctagaacttaattaggcagcgtgttcagcgatcctatggatctctctgctgcaatagtatttggtcagaacagacctggggattccctgcctccaaaaaataaaaagctaaaaagctaaatttaaaaata

SEQ ID NO: 20546 - DNA, 935 bp, Homo sapiens
gagatattctcattttcttagattgacataatcagcaattttgaacagtgtgtaaaatcaatgaacaaggtcctgccgcgatagatgccgtataggattccagttaatttctgaaagaaattgctaaatttaaccctacgtggcacagtgaatcgtacgaaggacactacaccatctgttccctgtaagtttagataaataaatgttttttatagtgtcacgaaagctaattttacaactgaatgagccttataaaacttgtaaacattgtataaacttatttcgaggaggtagaccagctacaaatgactgacaatacatgaacagattctggaggcttaaacaggtagataaagttgttctcaccaattattccccacacacttctggttgaattaggtaggcaccttgtttttgctagtgcactgcgagatccattctttgcctatatagaaacttacaggtatcttgggaattctgcttactcagttttcaaattcctgtgtttcttttggtcttgttgaaatcatactgttaggaatatattttataatagattaaattggcatgaataggttggcttaatttctgtgggacaaatgggttttggatttcaaatcatatatttaaaataatagccttttggatcataaccccagtttgaggattgcctttgttatagtgcctgcctcttctcacataattaatgttatgctatcagttattgtttcaattgtaaaaatctcctgtactaaattattttattccttgggtccagtgaggagatttttcctatttgtactgaagtcagctgacatttttaaaatcaaatttgtatttgtagaaatatcaggaacctaccttgggacagaaattccccaggaaatactctggtgcctgtaccagtttctcaagtggaaggagaagaaccgaag

SEQ ID NO: 20547 - DNA, 1709 bp, Homo sapiens
  misc_feature (1642)..(1642): n is a, c, g, or t
ggtgacactgccttacatgaactgagggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgtttnaggaagtttaaaacccttgaacatttcttcaaaaccaccaagtaagggatatgtttgttttattctc

SEQ ID NO: 20548 - DNA, 1825 bp, Homo sapiens
  misc_feature (1758)..(1758): n is a, c, g, or t
ggtgacactgccttacatgaactgagggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgtttnaggaagtttaaaacccttgaacatttcttcaaaaccaccaagtaagggatatgtttgttttattctc

SEQ ID NO: 20549 - DNA, 1850 bp, Homo sapiens
  misc_feature (1783)..(1783): n is a, c, g, or t
ggtgacactgccttacatgaactgagggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgcccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgtttnaggaagtttaaaacccttgaacatttcttcaaaaccaccaagtaagggatatgtttgttttattctc

SEQ ID NO: 20550 - DNA, 1459 bp, Homo sapiens
ggtgacactgccttacatgaactgagggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 20551 - DNA, 2380 bp, Homo sapiens
gatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccttttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatcttt

SEQ ID NO: 20552 - DNA, 1507 bp, Homo sapiens
gatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaataaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatcttt

SEQ ID NO: 20553 - DNA, 1230 bp, Homo sapiens
ctgacaaaatgatgcgtgccagaaaacggggagtatttgatgaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatcttt

SEQ ID NO: 20554 - DNA, 383 bp, Homo sapiens
agtagagacagggtttcaccatgttggccaggctggtctcgaactcctgacctcaggtgatccacccgccttgacctcccaaactgctgggattacaggcgtaagccaccatgcccggcctctacaaagctttagagttagatcatagaggtcaccttgtccatgatctcgatttggcagtgaggatactgagccctagagaagacttgctcaaggccacatagcatgtcagaagcagagacaggatggaacctgggtatcttgactccctacccagttctctttccgagtactctgtctttagtttgaataattgacagcattttgcaggactttctgcagcaaattttccaaccctgcatctattaggaactgagccaaac

SEQ ID NO: 20555 - DNA, 347 bp, Homo sapiens
tggctacatgcaacagaatttcaaggaaagaagtctgagatagaaataaatttgaaacttgtacgcctttagatgctatttaaagccataaaactggatgagatcaccaagagggtgggtgcagacagagaaaaggtctaaagactgaatcctgaaacacaacatttagccatcagggacataaggaggaactatcaaagttgctggtgaggtaggagaaaaatcaagagagaatagtatcttaaaagccaaatgaagaaagtacttgaaggatgaaaaaaaaggattaaattggctcatgctacagataggtcaaaacaagaacttggaaataaatcaaacaacaa

SEQ ID NO: 20556 - DNA, 805 bp, Homo sapiens
tttgttccggagcgagtaggacgcgctacctcctggaggaaagaagcgactgcgtttcgcagtgctgacttttttttacagtgtgagctaacgtgtatgctctgaaaaacaccccgttttccagtatgtgaatgagtatatttgtacggggccagtacggcagacatagcgggtcgttggaccgagcccaccgagagtggatctgtgggaagccactgtggcaccttgctgagtctgttcacccgtgcagctagctggtggcagccctggcagatcccggcacacagtcaggctccacgccttacccgagccagttgtgcctctagattacgcctcgcttaaagtccagcgaccaagatagaaaaacagccccacgatgcaaccattttggaaaaccgctgcagtttctgccaaagctaaatgtacgcttaccttgtgaccccagaaatttcacttcaagaggaatgagtgcatacgtccaccaaaggcatgtgcaagaatgtccatagcacgtttattcgtagtagtaaaaaactggtaacctaaatgtccatcagcagttgagtggctaaattgtggtgtatcatacagtggatttctacagagaaataggaagttacggataaacgcaacagcctgaacgaatagcagctactgttaacttaggcacaaagaagaggacgctgtatgattccattttgatgaggttcaaaatataactgcacagcaagttgttctccagtatgaatcaggaatcgtaccagcctggggaacatggcgagatcccatctttgcgcgtcggggt

SEQ ID NO: 20557 - DNA, 277 bp, Homo sapiens
gtatcagtcaattttggttcagaaataacattcttgtcaattatgtcatcaataccatggactcagaccaggttttggccatggtcacttgaagtcttcatgtccacacttaattgctttagtctaatgtctttctgaaagcttcttgcaggcaattataatcccagagagttatgtcttcaaggagcttcatggaaagaatgaagtctgacaagtacgggtttctaataactttgagttcacactattgaactaaatttccaaaactcggccaggc

SEQ ID NO: 20558 - DNA, 574 bp, Homo sapiens
tctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtgccttagtcactgcctcgggccaggttgcaagacccctcctaccaactgagctacaaatcacagttcctggagggtgggcctttatataacagggaacagaactcttctgtacctcccacctccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttggaaggatgaggtgggaggatcgcttgaacccggtgggtagaggctatggtgagttataattgtaccactgcactccagcctgggcaacagagcaagatcctgtttcaacaaa

SEQ ID NO: 20559 - DNA, 436 bp, Homo sapiens
agatgtgggaattatcagactaggaatcaatgtggtaaggggtctaatggataagatagaagcatgcaagaaaagatgaataatgtaagcagagagatgaaaattataagtaaacctctaaaagaaatgctagatattaaaaacgctgttacagaaataaagaatgcttttaataggctcatcagtggactggacatggttgaacaaacaatcactgagcttgaggatttttcaataaaacctcaaaactgaaaagcaaagagaaataaagactggggaaaagtaatacaatgcatgaagcagaatacacatttttatttcaagtacattcagaactttgactaagatagactgtattctgaactaaataaaagtcttaatattaagaagattcaaattatgaaacatattatctgagactggagtaaaactaaat

SEQ ID NO: 20560 - DNA, 160 bp, Homo sapiens
taattgctgttgttgtttttacttactttctgtcttctgtaacttcagtatatgcacagtaaaggcagggtctttaactgccatgtccactgctatatctctaggacccagaacagtatccagtacatcctaggaatttaataaatattagttgaataaa

SEQ ID NO: 20561 - DNA, 563 bp, Homo sapiens
aaatttcttttggtaggcgggacccacagatgcatgcaatacttctagatcagttttttcatctgggcacttgacattttggaccagataatttattattttgagggttgttctgtgcatcacaggatgttcagcatccgcagtagcactccccgtccagttgtgacaatcaccaatgcttccagatattgctagatgtccctgggagtggcgcagaatcgaccctggctgagaaccactgctctagatcttcattaggaattgtaacgtgaaagcctccaaacttttagatgttgagttaatttaaacatcttttggtcgagtgctgtggctcacacctataatcccagcactttgggaggccaaggcaggtggattgcttgaggtcaggagttcgagaccagcctggccaacatagtgaaacctcatttttactaaaaatacaaaaattagttgggcgtggtggcatgcgcctgtattcccagctacccgggaggctgagtcaggagaattacttgaaccctgggagcggagagccgagattgtgccactgcactccagcc

SEQ ID NO: 20562 - DNA, 207 bp, Homo sapiens
gataattcgtctcattcttatattagtcacttccccacggtagcagaattatctttttaagatgaaaatctaaaggtttgctgggcgtggtggctcacgcctgtaatcccagcactttgggaggctgaggcaggtggatcacgaggtcaggagttcaagaccagcctggccaagatggtgaaaccccgtctctactaaaaatacaaa

SEQ ID NO: 20563 - DNA, 447 bp, Homo sapiens
tttaattcacattagttgcacgccttggtgctatgaccatccctccagattcacaagtgcaggtccagccccatcttgttcagcactgtaacatgctttcagggctgtacatgcattcagttctctcccgtgttctgccatgtggagctgggccaagactctcccttttggcatagaccccaaagacagtcctgtggactggggatgtgtacggtccgagaggcgccagtaggtgcggaacatggctctgaacccagcgccacctgctgtgctcctcaggctgggtagggacagagaagacctgtgctcccagcctcactggaagccacacttccctgaggctgcctgcccccacgtggggtagaaatcagctccttggtccgttctgatgttcattgtctcaaagatgcatttgagaagcccttgggatcaagacaagtccctctg

SEQ ID NO: 20564 - DNA, 990 bp, Homo sapiens
tcctgtggttgggagggtgaggggcgtgttgtttctgctgctgaccccagtttcagggcaaatttaacctgtggtcagtgcagggtggggctttggtcccaggccctggggctgaggccctggagaacctgccaggcctgggcagtcactgctgacgtctgtggccagagtctccaagcgctgagggccccctggggcctgatttatgggggtctttgggggacttgttccagcctggaaatgtgagagggaaatctccccaccccagtgggggtgccccctggtgcacagctgggcagtgggcacccccgtgacttgtccgagagcaccgtttccctctggtgttaccctttaaaactcacttgagggaagagtgattggctacatagttgaatttgctgagcagcgtttgcagaggatgtaaactgccaggtaggctggccctgcttactggtctcttctttgggctcactgagtgactgagtggctttcgctttgatcagaaatgtgaacaggccgggcgcggtggctcacgcctgtaatcctagaactttgggaggctgaggcaggagaattgcctgaacccaggaggcggaggttgcagtgaaccaaaatcacaacactgcactccagcctgggagacaaaactccttctcaaaaaaaaaaaaaaaaaagaaaaaaaaagaaatgtgagcagttgaagattttagaactgatgtggctctcagagagttgggagacattttaaggcaaatgcaaaatgaaaacgtgtcttttgcttaaggctgtgtcttaagcaggggccttgggaaatgaaacgggatcttgccgcttcgcctcctgatttctggagctgttgacttctcagcctttttctgtgacatgtgcagcatctggacctgatttacgggagtctttgggggatttgttccagcctggaaatatgagagggaaatctcactgccccaggagaggagtcagtgcttaggg

SEQ ID NO: 20565 - DNA, 1075 bp, Homo sapiens
agaaagtggaccatctcttggtgtttgttttgatgagacttgacctatataacactggctcaagtatgtttgttaaagtgaatcacctgttgctttctgggccatacgtgaaatgacgtgccatgttacagtgaaccccttttgcaccaccccaagttcaggttgcccttacacaatttgggcgagatagatgaacacgcaccttcctccttcttagaaacaaaacagtgacttgggtagggtagacattaggaaagtgacttagctggtaaatatgtgattaataatggagatttggcctaagcatgagtgcgagcctctgaatacggatgggtaaatgataaatagcaagtctgccaagttgagcacattggggaacctcttgggctctgttcatgcttgaagtatgactgtgccaatactgtactcgctatttaacaaaatgaggtcataccaatcacactattttgcacgtatttgtttacacatctcttgtctgctaagctatgagctctttgagagcagggactgtttctgtttatcgttgttttctagcatctagcagagtgcttagcatataataaatgtgtattggatgaatgaatgaacgaatgaaattctttgcatttttactcggttagagagattttttgaaaggcatatatgtgggattatttgtgccgtcatctgctaatttcacagatgtcttctcaactgtagaccttcatataagggaaagacctatttacgcatagttgagttgcagctgctgctgccctggcctgatggcacagtggtgagggctgtctcaatatctgtcccatgtctctttcatagaataataccctccctcagccccttttccctgtatcttcctttcaagggttgctgtgtagttaactctgcttcaggcaatttatcttatctgtacttttctcttcctcattcctcttctcttttccagtgcttgtccagtaacctcaaggaaatctgttccaacccttctttgctgttggtgtattcctattcatgagttaaatcccaaacaaaacatactctaatcagggcagtcgaa

SEQ ID NO: 20566 - DNA, 606 bp, Homo sapiens
agaaagtggaccatctcttggtgtttgttttgatgagacttgacctatataacactggctcaagtatgtttgttaaagtgaatcacctgttgctttctgggccatacgtgaaatgacgtgccatgttacagtgaaccccttttgcaccaccccaagttcaggttgcccttacacaatttgggcgagatagatgaacacgcaccttcctccttcttagaaacaaaacagtgacttgggtagggtagacattaggaaagtgacttagctggtaaatatgtgattaataatggagatttggcctaagcatgagtgcgagcctctgaatacggatgggtaaatgataaatagcaagtctgccaagttgagcacattggggaacctcttgggctctgttcatgcttgaagtatgactgtgccaatactgtactcgctatttaacaaaatgaggtcataccaatcacactattttgcacgtatttgtttacacatctcttgtctgctaagctatgagctctttcaagaagcacggagctggccagttcatatcgctgatataggctatccagggcaggaagaaaggctcagatagtttctagcatgaaatat

SEQ ID NO: 20567 - DNA, 577 bp, Homo sapiens
taataaatttgaacataagagaataataactctacctgctaaacaagcacattcatgcataagcaactcgagtggctcaatcatctgtcaaatatcgaaattctcaaaactgtacattttcattgaaggttacttgtttgagatcttcccaggctgcctgtctgcaagtcttagactataactagccaagaaggattctggaaactacacttatccggtccttcagccttcacctggccactcttttcaaagagaccaaatgagttgacacatttaaagtgcttaggacaggcggggggcagacagccaggcgtggtggttcacgcctataatcccagcactttggaagaccgaagtgggcggatcatcttaggtcaggagtttgagaccagcccggccaatgtggtgaaaccctgtctctactaaaatacaaaacttagccaggagtggtggcgtgtgcctatagtcccagctactcgggaggctgaggaaggagaattgcttgaacccaggaggtggaagttgcagtgagccgagatcatgccactgcactcctccctgggtgacagagcgagac

SEQ ID NO: 20568 - DNA, 313 bp, Homo sapiens
gaaagtgctttttcaaaagctgttacctacaaataattaaaaaaaaaattagccgggtgtggtggcacctgtagtcccatctacttgggaggctgaggcaggagggtcacttgagctcagaaggtgaaagttgcagtgagccgagatcacaccattgcactccagcctgggcaacagagcaagaccctgtctcaaacacagaaacaaagctcttgtccagaggcttcgtttgggctcattggcttttgtaacagcagtgtttttaaggaacaatcttctaataagagcatccacttataagaccatggagtct

SEQ ID NO: 20569 - DNA, 164 bp, Homo sapiens
ccgagattcaggctgctcattcgtcaactagagagagaataacagtgtctccctcacgcccttattgtgaggcctggtaaggtgactcatgaatggggcttagctcaggagatgctgtccacccctcccaggcccaggcaaccttgtccagggttcccatctct

SEQ ID NO: 20570 - DNA, 1389 bp, Homo sapiens
tgcctgttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttt

SEQ ID NO: 20571 - DNA, 587 bp, Homo sapiens
agatcgagctcggaccgtggttgacgtggcttgtgggttgacgtgctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttt

SEQ ID NO: 20572 - DNA, 315 bp, Homo sapiens
gatatatgggacacatatgtgaccaaaaactgaaattctgggagttctggatggagatgagatgggtaaaggcataaaaaacctatttaatgaaataataactgaaaacttcctgaatgcttccaaatgcaggaagctcaaagattaccaaataaatacaactcaaaaaggtcttctccaaggcacattatggtaaaattgtcaaaagacaaagagaaaatgctaaaaacagcaagagaaagacatcaagtcacttataagagaatctccatcaggctaacgggatttctcagcagaaaccttacaggctaggag

SEQ ID NO: 20573 - DNA, 339 bp, Homo sapiens
atggaaaattctgtcactaaatagatgaacggtcctcttgagtccttcccaggatgccagacaagtgttctcagcaggggctttctcatctttggggattttactttggaaaaaaaagttggacagataaaggcacactgacaagtgagcttttggacggagaaatgaggctaggaagcttcttctccagaagagagtgttggccaattagggggtttcactagaggtactgaccttgacatcctcttgtaattttgtttttaggtcttgtttattgtgcacttttatttcaaatgcacttaagtataacaataaagaatataatcaccactacctcca

SEQ ID NO: 20574 - DNA, 299 bp, Homo sapiens
aactcacccacctgacaggtgacatccttggtgagacaattgtgggcagcctgacacccagtgagattcagcagctgctgcgggtccccacgggctgccctgagcagacgctgagctccctgacgcccgtcatcatcctgtcccgctatttggataccaccggccagtggggcaaggtcggggtggagcacagggaccaggtgatgaagaatattgtcagcggctacactcagatgctgacccaccggagttcagacggcacctaccacacctccaaggggaacccaggaagcacttgg

SEQ ID NO: 20575 - DNA, 412 bp, Homo sapiens
catttcaccaatctattaactcaacaaattcgtttcctactctaagccaggcattcatttcagggaaataagaaaaggaattgccagatatcaaagcattaaaagaaaggcgggctgggcgcggaggctcacgcctgcaatcccagcactttgggaggcgggcggatcacaaggtcaggagtttgagaccaacctggccaatatggtgaaaccctatctttactaaaaatacaaaaattagctgggtgtggaattagctgggcgtggtgtctggtgcctgtaatctcagcaactcagggggctgaggtaggagaatcgcttgaaaccagacgacagaggttgcggtgagccgagatcgcatcactgcactccaacctgggtaaaagagtgaaattctgtctcaaaaaaaaaa

SEQ ID NO: 20576 - DNA, 316 bp, Homo sapiens
aaagctgtttggatatactacatagaagtaatagctaccatgaacatagtttgagtttaaagtcttttaaaaagtttgagttttaggttttaaggggtgcggactggggagtaaaagatgaagggaaagagaagagagcaagttaatgtgttgatttaactgcaaaataataacaggatgtaacagagttctgagtatccaaagtgaccaatcagagcctaaacatagctgaattccatcccagccccagcacgtccctaacacaagaataaaacccttatcttgttcagccatgtgtcgcctgccacaaactgca

SEQ ID NO: 20577 - DNA, 1132 bp, Homo sapiens
  misc_feature (1098)..(1098): n is a, c, g, or t
  misc_feature (1103)..(1103): n is a, c, g, or t
ttagtagagacagggtttctccatgctagccaggctggtctcaaactcctgacctcaagtgatccgcccgacttcgcctcccatagtgctgggattacagacatgagccaccgcactcggtcctgtgaattccatttttaagagaataccatggggcagtcttggtcacttgtcaaactgggtcccttagaggtacacgaagacactctaagtggtgtataagtgggaggataacttgcaaggactacgcttccagacccccagggtgtaggtatctcctaaagctgatctgagttgtaagttaccattttccacctctgctttcacaatctcttttctccacgttacaaaagaaagctgtatcttccacccagccccaatcctgctgttggcttcatcttgggcaaagaggcaatttgaaatattggtgtttgttaggaaaaagtgatccactctgattggatgacaaattctttagtaactttggtggttttcagatcgttccttttagtaaaattgaaggaggacccaatgaatttgacaactgatagatcattcaagttacttttaatgatggctcactgtgtgatttttagatgaaacactgaggtagtttagagaatatacggatagtgctgtaataaagctgtttcagtacttacaagctttttcagtacttacatttaaaaaagttaaaaaggaaaggattaagttgataaaaaacctgtctcattctagtagtgggtaatgttcacatcaaccagttggggggaaaatagctctgttcatctcattaaaggatgcattttcaataagattttactttctgtgtttaattacctatcaaaatttgtaaaacttgttggtttgatcaattgtatgcagtcggccctctgtatctgtgacttctgcattcgtggattcaacaaactgtggatcgaaaatacagaaaaaaaaagtatctgtactgaatatgtacagactttttcttgtcattattccttaatacagtataaaaactatttacatagcattcacattgtattaggtattattaagttaaccctaaaagaatggaattttaaaaggttttaccanggganggaatggtggccattaaggggtttattat

SEQ ID NO: 20578 - DNA, 1285 bp, Homo sapiens
ttagtagagacagggtttctccatgctagccaggctggtctcaaactcctgacctcaagtgatccgcccgacttcgcctcccatagtgctgggattacagacatgagccaccgcactcggtcctgtgaattccatttttaagagaataccatggggcagtcttggtcacttgtcaaactgggtcccttagaggtacacgaagacactctaagtggtgtataagtgggaggataacttgcaaggactacgcttccagacccccagggtgtaggtatctcctaaagctgatctgagttgtaagttaccattttccacctctgctttcacaatctcttttctccacgttacaaaagaaagctgtatcttccacccagccccaatcctgctgttggcttcatcttgggcaaagaggcaatttgaaatattggtgtttgttaggaaaaagtgatccactctgattggatgacaaattctttagtaactttggtggttttcagatcgttccttttagtaaaattgaaggaggacccaatgaatttgacaactgatagatcattcaagttacttttaatgatggctcactgtgtgatttttagatgaaacactgaggtagtttagagaatatacggatagtgctgtaataaagctgtttcagtacttacaagctttttcagtacttacatttaaaaaagttaaaaaggaaaggattaagttgataaaaaacctgtctcattctagtagtgggtaatgttcacatcaaccagttggggggaaaatagctctgttcatctcattaaaggatgcattttcaataagattttactttctgtgtttaattacctatcaaaatttgtaaaacttgttggtttgatcaattgtatgcagtcggccctctgtatctgtgacttctgcattcgtggattcaacaaactgtggatcgaaaatacagaaaaaaaaagtatctgtactgaatatgtacagactttttcttgtcattattccttaatacagtataaaaactatttacatagcattcacattgtattaggtattattagtaacctagagatgatttaaagtatacaggaggatgtgcataggttatatgcaaatactatataccattttatatcagggacttgagcatcttcagaatttgatattcttgagacgtcctggaaccaatctctcagggattcgactgtactaatacaaattgtattgataactttttttgtttttggaaacagtgtctcactccagccttggagacagattccatctc

SEQ ID NO: 20579 - DNA, 766 bp, Homo sapiens
cttctttaagagatggtggcttcctatgttgcccaggatggactcaaactcctgggctcaaggaatcctctcatctcaggctcccgagtagctaggaatacagacacgagccaccatgtctagctggaagttagactttatctgcattcctggaatagtaaaagcaaagcacgggtcagctgctttcggtaaattctagcccataggtccaagtcaagttccaggaagccccctatgaaaaagattctgatattagtaccagtgtttagttcatgtcatggcctgacttaagtataggtcattaagtgtaatgccaaggcaggggcttgagtggtttggagctcatgactgttccacttggaatttatcctggtgtatgaatacgaatctatcaatattttttttcaggtggcttcccagttctcccaacacttttactgaaaagatactgtctaactatttatgtcaatatagaaacataaagtcaaatatatttgtttagtagacttgaagagagcctagaaacacactcagagacatgtaaacagcatcagacgaagatggcatttcaaatcagagttgaatggatttttcagctttgctgaggtataactgaagtgtactaaactgcacatatttaaaacatataatttgatacattttgactcacaaaacaatcaccacaatcaagatgatgaatatatagatcactcccaaaagtttccctgtagtcttttgcagtcctttcttcatggccttcttcatc

SEQ ID NO: 20580 - DNA, 220 bp, Homo sapiens
ctcttagcagagtctggtactcttagcagagtctgctaccccagggctgcagagtctacctgggttaggtgctagttgtttaccagggttcagcatcagtctgaactgagcttctatacagcaagtggccactaagtgccttagtggtttctggttacacctggggaacagggtccttaatatcctaaaagaatatttttatactgatagttattttatc

SEQ ID NO: 20581 - DNA, 1539 bp, Homo sapiens
ctcaagcaggcgtttgcgagaggagatacgagctggacgcctggcccttccctcccaccgggtcctagtccaccgctcccggcgccggctccccgcctctcccgctatgtaccgaccgcgagcccgggcggctcccgagggcagggtccggggctgcgcggtgcccagcaccgtgctcctgctgctcgcctacctggcttacctggcgctgggcaccggcgtgttctggacgctggagggccgcgcggcgcaggactccagccgcagcttccagcgcgacaagtgggagctgttgcagaacttcacgtgtctggaccgcccggcgctggactcgctgatccgggatgtcgtccaagcatacaaaaacggagccagcctcctcagcaacaccaccagcatggggcgctgggagctcgtgggctccttcttcttttctgtgtccaccatcaccaccattggctatggcaacctgagccccaacacgatggctgcccgcctcttctgcatcttctttgcccttgtggggatcccactcaacctcgtggtgctcaaccgactggggcatctcatgcagcagggagtaaaccactgggccagcaggctggggggcacctggcaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatctatgaaatcccaaaaaaaaaaaa

SEQ ID NO: 20582 - DNA, 1069 bp, Homo sapiens
cagaggcccaggcagggaacctggagaacacggaccaggtgaagagcccccttcttactggggacagctctggcctgcctccagctccctcggctcccacgcatggggtgaaggcctcaggaggcctggggacaatgttgcacccacaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatctatgaaatcccaaaaaaaaaaaa

SEQ ID NO: 20583 - DNA, 632 bp, Homo sapiens
ggttagggaggatttgtagaattctagcaggtaaaaatcaagcctttttcccctcccatagtaaacttaaccattttcaccctgtacgttatcttctagctcctactaacatctccaattagacaaccgcttcaaagggtgcttagcaccagggattggggttcatggacttaggaggtggtaaggaaactggctggcaccaccaaactgccttagtgaacttggcccttcccaggcaggtaggttgggcattgagggaaggtggcccagtctttgctggcagggtctggccagtctcatgggggcaccaccagtttggtgacagaagtggtgtcatttattgaattccacctccgtttagaaggagatcatggtacaaagcccaggaggggccttaagatgtgaagatctctctgagtaaaaggcaaggggcttctcttcttcacctctgggatagttggtagatcggagagttttattttcagggtcaaggctgtggactgatggggatattggagggtgggtgggttttcctgagagactttgtataatgctgaatgtgtccagagggacaagtttgcagaacctcatattggtatattaaagaaataataaaataaaaaagcacttta

SEQ ID NO: 20584 - DNA, 1128 bp, Homo sapiens
ggttagggaggatttgtagaattctagcaggtaaaaatcaagcctttttcccctcccatagtaaacttaaccattttcaccctgtacgttatcttctagctcctactaacatctccaattagacaaccgcttcaaagggtgcttagcaccagggattggggttcatggacttaggaggtggtaaggaaactggctggcaccaccaaactgccttagtgaacttggcccttcccaggcaggtaggttgggcattgagggaaggtggcccagtctttgctggcagggtctggccagtctcatgggggcaccaccagtttggtgacagaagtggtgtcatttattgaattccacctccgtttagaaggagatcatggtacaaagcccaggaggggccttaagatgtgaagatctctctgagtaaaaggcaaggggcttctcttcttcacctctgggatagttggtagatcggagagttttattttcagggtcaaggctgtggactgatggggatattggagggtgggtgggttttcctgagagactttgtataatgctgaatgtgtccagagggacaagtttgcagaacctcatattggtatattaaagaaataataaaataaaaaagcactttaggttattttatctttaacccgattgctgcaatttcttttgtgtgtatatatacatatatatactttccacaaagttttattttttgctcagaataaaaagttaaattgaggtgtgaaaagaaaagcacttaccttggtgcaatatgtgtagcttgatggtcgttgtcccatgtggccctggcctggcagcgtttttccgctcaatcagccctgtgctgtgagactgtccatagggaaacactattatgcattctcagcaaccgctcaatctatgcaagccttccctgtgtgccccagggcgccccctcaggctctctgaagaactgctgtgggtcctgttttctgctgactgttgaggccctttttcatcacttcttggtctctcgccatcttttccctcttcaccattacaaaatgatgcctgaaaggaaggaacagattgttcctaggtagaaacctggcaccttctagacttttatatttgtaatcacatcca

SEQ ID NO: 20585 - DNA, 573 bp, Homo sapiens
  misc_feature (100)..(100): n is a, c, g, or t
  misc_feature (107)..(107): n is a, c, g, or t
  misc_feature (138)..(138): n is a, c, g, or t
  misc_feature (144)..(144): n is a, c, g, or t
  misc_feature (146)..(146): n is a, c, g, or t
aatgttggggtcaccttttaatatgggggtggtatatatacttatatatctaatacgtaacccaaaggctgtttgagaacctcttgcatgtttaatacantgtgatnattccactgaatggatattctgtggttcatnttaccnanccctgtatgggtatgggttggggaaaaaaacctgttaaaacttgcaagttttcagtggaacattaaagacccacttgagctgtggttttttatttaaatgtaatgctacaaatcagcctgtgccttagacattattacattgtctattctagatctactaatttaaaatatcttatagcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgagtacttttgtggacttagaatgggggttttggttgtgggaatgagtctttgggtatactgtattatgttgaaaatttgtaccgcggtgccgcgt

SEQ ID NO: 20586 - DNA, 454 bp, Homo sapiens
agtcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgagtacttttgtggacttagaatgggggttttggttgtgggaatgagtctttgggtatactgtattatgttgaaaatttgtaccgcggtgccgcgt

SEQ ID NO: 20587 - DNA, 461 bp, Homo sapiens
cgtgaagccctgcaagaacctagtaccttgagggcagagactgaaccatctgtggatgagaccttatgcccaggaccttacaggcacaaagatcgactcagaaggggtttggtgtatgtccagaaggatggcgggagaggagcttctcagcatccaagaaagtttcacatagctagcaatggttttactgagttttaagaattgttttattgtggctggacacagcctcaagcctgtaatcccagcactttgggaggccaaggcaggaggatcgcttgagcccaggagttcaagaccaacctgagcaacatagtgataccctggctctacaaaaattaaaaaattagtcaggtgtggtggcatgcgtttgaggtcccagctatccaggagactgaggtgggaggattgcttgagcctgggaggccgaagctgcagtgagccaagatcacaccactgctctg

SEQ ID NO: 20588 - DNA, 381 bp, Homo sapiens
tggtatataatacccccataacatgcaatttacctatataacaaacctgcatatgtaccccaaacctaaaagttaaaaaataaataaaaaataaatgaaatggtgtacaagcaccgaattctcagcacctctttgagttactcatcactgagttttcccacatgaatacatgttgccaagtgtaaaactctattatgcatctccatgtcctcatcaccacaggtagctttactgaagaaaactaaaaaactttcaaacaagtggtctttgtcttataaagtgctggaaaatagaataaaagaaaaagctgcttaagttaatttacaacattactgtaattttgattcaaagccagatagcaacagtctaagaaaattacag

SEQ ID NO: 20589 - DNA, 431 bp, Homo sapiens
aatattaaaacatcctgataccctcacatttaattcaaaaacttgtcctcatgatgtcattcaatataatatacttgaacattaaaatgtatataataaaatatatttattcaaagatttattcaaaataaaatgaatatataaaataagagacagggaaagagaggtgtctggggagtgactagtgattagtatcacagaaatccttgcttcatctttaccgaccccctggtgaaagacaatttaatctcccgacaaactctttctcattattgtataaacaaaaaacagtctctcttactttaaagaaaaataaaaggctgccatttacttcatgacccctatctcccttttatcagtcactcttctgttaagagtattctttgcttccatgtttttatttggataaaactgactatgatgcattgttg

SEQ ID NO: 20590 - DNA, 438 bp, Homo sapiens
atgaatctcttggggtttcttgaatttaattgtaatagtcattttttctgccattagtaccaaggaaaaaagccaatattttagggcacagaatggtagaaaggggtctactttgtgtgtgtgtgtgtatgcgtgggctgtgtgtgtgtgtgtatgtgtatgtgtgtgtgtgtgcgcctatagagaaaagaaagcttactgaactaggagtcagaacacctgtgttgaagtttgggcacattccccaattccccaagcctcagtttgctcatctataaaatagccggagtgatccttgcctcacctgattcgtggttggtgatgatcaaatgaggcaatgaatgagaaagcctttgcgttagcctctgttttgctggttattaaacagatgccttcctcccttgactgttctttgagaataaagccagaaaagatttg

SEQ ID NO: 20591 - DNA, 506 bp, Homo sapiens
gcttctagtagctctggagattcctggcttgcagctgcaactcttcaagctcggcctccatgattgcgtggcattctgtcatttgtatgtgacttcatattgtatgaagaaatgaagatacctccatgtgtccatgtcttgttatatggacataagtcatattggattaagagctcaccttcctccagtaaaacttcatcttaactaattcaatttgttacaaccctatttccaaataaggtcacattctgagatcctgcgagttaggacttcaacataactttatgggggatacaattcaatccataacaggtggtcagggcctgaattaagtagagattatggcattaaggatgttgaaagctaatagctggcatgagaatctgaatgaagaatgaatggcatccctacaatgggggtttgggacataatcccaaaagacaccatcctgaataccgtaaaccctattgtgaagatcctgaaagattgaaatcctgaaagtgtaa

SEQ ID NO: 20592 - DNA, 242 bp, Homo sapiens
agggtgaataggtcacggcggccttttttttttagtttaacttttcctttttttgctgtctagtcatcctcgtcggtcttctgcttcttggtatcgacatcgtcatcctcatcatcttcagctgcccgcttgcccgtagctgacacagcttcctcatcttcatctccatcctcttcctcaccatcaccttcttcttcctcctcctcttcctccccaccttcttccccttctgtcgtcttctc

SEQ ID NO: 20593 - DNA, 377 bp, Homo sapiens
gtatgtatttcggggtattttataaaactatccatgccatgtatgatgcctcacctgcaaggataaagctttaacatatatgaaaaataagtgtctttggttcttaatatcttcctacatttgtcttcataacttcaacacaaaaacactcatatactcgacttttggctgggctgactaccagttattaggatttaagtaaatagaataaagatttcaaaattcgatgaccaaatatgagaaatcacactctccccgtaacatacaattattctcaagtgccactgctaatgcaaaattgaaagaagaaattaagtctaatatattgcaatattctaaaatctaaaattttttctttgaggtctggtggttcatgc

SEQ ID NO: 20594 - DNA, 468 bp, Homo sapiens
tgtactagatggttttgcctaactataggctagtgtaagtgttctgagcacgtttagaatgtgctagaagcaggctaggctaagctataatgttcggtaggttaggtgtatttgatgcatttttgactttccatttatgaggacataaccctatcataaattgagtagcatctgtattcccaatggcatacagagctgtaaaaaatacagaaaacaatcccgatctcactggccttaaagtctagcaatggagtgtgacaaagaacaataaacaaggtaaagaagtagaataaggtggtaaagaaataaaaaaagcaaaaggaaaaaagaacaggaagtgaattaattcattcattacacggtgagtgaatctgagaaagaacggtcagaaaccggttcactaaggaaacagcatttaaatacggacctacaggaggcaagaggtaacaatcttgtactatacttctc

SEQ ID NO: 20595 - DNA, 461 bp, Homo sapiens
attgaaaagtgaggagggcagaatttattaagtgaaaaggaaaactctcaacaaaaagaggggtcctgcatgcaggttttccatctcactaaactgaataccaggccaccacacatgagctgaagagcctagtcttctccccctgcatgaattcctggtggctacaccccgttctcccagtgtgcaggcaggcccttagtctgagccactccacattatttcccttactgtgtatgtgttaaggaacggaatttttcatcatgggcatgtttaggcaatccccctgtgcacaatgacctgggcagcatttggctgtctcctgattctatcattcccccctctaaagaagtacatctaacttagaataaggataaggataagggtagtgatcgatcttaactggttcctgctgatgggggcactgttttgggaaaatagcagtgagatctccctcagaggcc

SEQ ID NO: 20596 - DNA, 388 bp, Homo sapiens
atgcgagctaacataaatagattgcttaaatatagtgttaaaaaagagatggtgaggaggactctcaaacccatgtcatgagactcaagtgaaaaaagcaggaatgggccagctgcagtggctcacaccagtattcccagctctttgttaggccaaggtgggaagattgcctgagcccaggagttcaagaccagcctgggcaatatagggagaccctatctctacaaaaaacttaaaaattagctgggtgtggtggcacatgcctgtagtcctagctgtttcagcaggctaagaaaggagaattatttgagcccaggttccaggctatagtaagctgtgatcgtgcccctgcattccagcctgagtgacagagcataatccatctcta

SEQ ID NO: 20597 - DNA, 999 bp, Homo sapiens
gataatattgacgcgtccggaaatgtcttacgatgatcatttagaggtttattttgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatagacatctgcatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcatactcgtctgaaacgactcaggtagaggctgaggaaggccgtgttgtttgtctacctgggactacacctactgaaagaagttctcaagttctgattgagttctaaaattttttgaagattggaattcttcatatgtaaaaagagaagagaaagacattcttgattttggtgactagagttgtagatgctggaagctttgccactaacattgatgaaccagatgcatgtcaccagcccatcacggtgattcttaagccggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggatccaggaaatatttgtgaggccatttggacttcagtgtgaaatggtgttaaaagatgaagtcatttattcaagaagtaaacctctgccacctggactgtgcgcagacatttcattgattttgtttaataaacattttctggctttgggaggtgt

SEQ ID NO: 20598 - DNA, 821 bp, Homo sapiens
gataatattgacgcgtccggaaatgtcttacgatgatcatttagaggtttattttgaacaactggcaattccaggaatgatggaataaagcatacgaagtagaaggactggaacctccagaaaaagtactttaagttacctacaggtgatcctagtcaggcaaatgaaaacagtagcctaaagtgtcagtttcaaccagaaaataacagctctgatttctcatggctcatactcgtctgaaacgactcaggtagaggctgaggaaggccgtgttgtttgtctacctgggactagtaagtatagaaatagaattcctttgttcttaaattctacctttgactttacttttaaaatataatttctttggtacgatttagctcatgcctataatcctagcattttgggaggccaaagagggagaattgcttgagcccaggagtttgagaccagactctacacacacacacacacacacacacacacacacacacacacacacacgcgcacacgaagcgggaatggtggcatgcgactgagaccccagctacctgggaggctgaggttggaggatcatttggacccaggaggtggaggctgcagtgaaccatgattgtgccactgtactccagcctgggtgacagagcaagaccctgtctcacaaaagaaaaagaagaagagatcatctattagtcttcttgatttttgttaaaatgtgttatgtgatagttgataagctttatgcatatgtcaatctgtggccatttaattttgggctaaggacttgttctattatagcacagtaatcattttactaaatagtg

SEQ ID NO: 20599 - DNA, 1452 bp, Homo sapiens
gataatattgacgcgtccggaaatgtcttacgatgatcatttagaggtttattttgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatagacatctgcatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcatactcgtctgaaacgactcaggtagaggctgaggaaggccgtgttgtttgtctacctgggactacacctactgaaagaagttctcaagttctgattgagttctaaaattttttgaagattggaattcttcatatgtaaaaagagaagagaaagacattcttgattttggtgactagagttgtagatgctggaagctttgccactaacattgatgaaccagatgcatgtcaccagcccatcacggtgattcttaagccggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggtggagtctcactctgttgcctgggctggagtgcaatggtgtgatcactgctcactgcaacctccgcctcctgggttcaagcagttctcctgcctcagcctcccaagtagctgcaattacaggtgcatgccaccactcccagcaaatttttatatttttagtggagacagggtttcaccatgttgaccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgttttttaattgttaagaattttctgtctagtttagatataagccctttatcagacatgtgttttgcaaatattttctcctagtctgtggcttgtattctgtctcttaacactcattttatttttacttttggaactaaagaagaagaatggtcagctttccattattcttgtaacagtaatggcagaaccaagtctgctaatgctacactgagcaaagaaagtcacctggtgaagtccaacatta

SEQ ID NO: 20600 - DNA, 1141 bp, Homo sapiens
gataatattgacgcgtccggaaatgtcttacgatgatcatttagaggtttattttgaacaactggcaattccaggaatgatggaataaagcatacgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatagacatctgcatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcatactcgtctgaaacgactcaggtagaggctgaggaaggccgtgttgtttgtctacctgggactacacctactgaaagaagttctcaagttctgattgagttctaaaattttttgaagattggaattcttcatatgtaaaaagagaagagaaagacattcttgattttggtgactagagttgtagatgctggaagctttgccactaacattgatgaaccagatgcatgtcaccagcccatcacggtgattcttaagccgttaagtatgaacatacagtaaaagactgttgatagaatacatcggtcttatgaaatgaaatgtgttggttaaggattttttaaacgaatttcacattacacaactggctttactaaatctgagtcttgtatttctgaacagggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggatccaggaaatatttgtgaggccatttggacttcagtgtgaaatggtgttaaaagatgaagtcatttattcaagaagtaaacctctgccacctggactgtgcgcagacatttcattgattttgtttaataaacattttctggctttgggaggtgt

SEQ ID NO: 20601 - DNA, 954 bp, Homo sapiens
gataatattgacgcgtccggaaatgtcttacgatgatcatttagaggtttattttgaacaactggcaattccaggaatgatggaataaagcatacgaagtagaaggactggaacctccagaaaaagtactttaagttacctacaggtgatcctagtcaggcaaatgaaaacagtagcctaaagtgtcagtttcaaccagaaaataacagctctgatttctcatggctcatactcgtctgaaacgactcaggtagaggctgaggaaggccgtgttgtttgtctacctgggactacacctactgaaagaagttctcaagttctgattgagttctaaaattttttgaagattggaattcttcatatgtaaaaagagaagagaaagacattcttgattttggtgactagagttgtagatgctggaagctttgccactaacattgatgaaccagatgcatgtcaccagcccatcacggtgattcttaagccgttaagtatgaacatacagtaaaagactgttgatagaatacatcggtcttatgaaatgaaatgtgttggttaaggattttttaaacgaatttcacattacacaactggctttactaaatctgagtcttgtatttctgaacagggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggatccaggaaatatttgtgaggccatttggacttcagtgtgaaatggtgttaaaagatgaagtcatttattcaagaagtaaacctctgccacctggactgtgcgcagacatttcattgattttgtttaataaacattttctggctttgggaggtgt

SEQ ID NO: 20602 - DNA, 463 bp, Homo sapiens
cattctaaaatctcatcagagaactactcagccaaagccacagagctagtaaatagtgggatcaggatctgggtctttgtggttctaaatcacacacccttagtcacaacaatactgtttcatgtgttgatgggttgattagagagcactttgacgggagaatactgacctctgaggttagggagggctcttgtaacattacctatctatatgctgtaatagattgcacatgctccctggtactacaattgttagtgtgtgtatccatttttttccttatggctgtaagctcattgaggagcaagaattgtggcttgtgcattttgtgtgtgtcccctctatttgtagcttggtgcctagacaatgaacattgaattggactaaaaagctgtagtagcactatccaacaggaatatcaagcaagccatacatctaattttaaaatttctagtagccacaagac

SEQ ID NO: 20603 - DNA, 147 bp, Homo sapiens
gttttacattaggaagtaatgagtaatctaatgacctggaagcttttcaaataaaaatttgcaggcatcatcctcagaaagtgtctgacctaactgggtatgggaatagcatctatgtattgagttttcaggtgattagagcataac

SEQ ID NO: 20604 - DNA, 252 bp, Homo sapiens
ttttcttgtttttagaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaa

SEQ ID NO: 20605 - DNA, 502 bp, Homo sapiens
ggaccttatgcaaatccagaacccagcagagcagacattaaatcttaaagttccaaaacaatctcctttgacttcatgatctgcatcctaggcacactggtgtgagggatggacctcaaaggcctcaggcagcctcactcccatggctttgctcagtccatgtggctgttctcatgggttaggttgaatgcctacagcttttccaggctgaggttgcacactgccagtggctctataattctggggtctggaggacaatggccctgcttccacagctccactgggcattgctctaatacaggtctctatgggggctgcaatctcacattcctgattgtcattaccttagcagaggctctctgtggtagctctgccccttcagcaggcttctgcctggacacctaggctttctgatgcatcctctgaaatctaggtggaagccaccaagagttctccaccactcttgcattctgggtgcctgcagacttaacaacatgtgata

SEQ ID NO: 20606 - DNA, 418 bp, Homo sapiens
tgagtcgagtatgactatagagtatataaaagggaaacacaaggcatcctagtggtgaaggaactgttctgtaccttgactatggtgatgtttatatgaatctatatatgtgattaaacggcatggaactaaatgcatacatatacaaatgagtgcatgtaagacaattaaaatctgaataaggttagtgtgtcaacaggtgactgtatcaatgtcctgattgtaatattttactacaattctacagaacgttaccacagggggaaactgagtgaggggcacatgggatctctacatgatttattcctactgatttaatgacatgtgaatctacaattagctcaaaagtataaaaaaaaagtgtatatatatatatatatatacacacacacacacacacacacaccttattttaacc

SEQ ID NO: 20607 - DNA, 384 bp, Homo sapiens
tgaggattgatcaggcaggggtatggtctaccacaccatggaaatcagagcgccacgcatcggcatggtacatgagctcatagctcttggaaaagtgactgctttgattgggggcaagtgggaggaaatacaggaattttaatctggcagtcatgagcaagacagagttaaatactgggattaggacacacagctaggacactgatcagaaggcaagaagccctaagcatgtgtgaagcagtaaatgagtaatagaaaaatggacctgctttagtgtcatcagtggtgctgagagcagataatcactcatgagccaagagagcaggctgatgatggattccacccaaagaaagctctcacaccacactgcatgggccagaggga

SEQ ID NO: 20608 - DNA, 189 bp, Homo sapiens
tatttgtcatttctttatgttgggaacaatttaagtcctgtcttccagctactttgaaatatataatacaatgttgttaacaatagttactatgctctcctttgacaacagagtatacctgttttctaatcttatgtttgtacctgttaagctaccgctcttcatcgtccacccctaccaacccatcct

SEQ ID NO: 20609 - DNA, 932 bp, Homo sapiens
aagaccctagcatagtggggcaagacagcagccctctgagaagagaggcacttgctgctgttttgtacatcggtcctgcaccgggcctcacgggcagggagccccgctttaatcaggcttccacacctcacggagggcttcttccagcttctgcctgtaggctgtgtagcgcctcttcaggttctgcagctgttcatcttcttccttgtccaagatgcgcaagaaattctgtagttctgggaaggctgaaggcttcccactgtcaggaaacacagaaagaaaaatgccagatgtttaatactcagttagacttaggaatgctgaccaggagctcccagaggtgcggctgccctcccctcccagccccatgccgcagaaggtgtggtctgcaagagctggggtgttgccagcctaagggctccctccactcccactcccacctcagctcacaccaatcaccttcctaccctctcctcccactgttcaagacgatctccctaaaagccagagacctccatatccctaagtctattggacactttcattccttacctgatttgacccccaacagcattaaaaacaattcgacagtcctttcatcttaacctcgagtcctcattgtaactgactttcttacctcgcataatcagtcttatcacccccaaacagttctccattcagccttttctccctcggtacggccccttggtgctagctactatcatctattcctgcatcgctggaacagcttcctacctggcctcctcactcggctcttatgctcccccatctgttccccaaacagaacatcctttgtaaaatgctcatctggccaagactctcccctgcttagaaccatccaatggcttcccttagttgctgatgctgtctgaaagactctaaactctccggccccatctctctctcaccga

SEQ ID NO: 20610 - DNA, 131 bp, Homo sapiens
gcttggtcttgaaggatctgttgacttttttgaagaaggtggggcaggggatgtgagtgacttgacacaaagactgtggtaaacccagtgggtgttagggacaggagttccctggtgtggtgtggtgctgt

SEQ ID NO: 20611 - DNA, 198 bp, Homo sapiens
ccttggttcctacaatcgcacttctatgcacgtaacaaaatttcacatgcaccctataaatatggacagctacgatgtattaataatattaggctgggcatgtttgctcacacctgtaatcccagcactttgggaagctgaggcaggaggatggatcacttgagcccaggagttcaagacgagcctgggcaacataat

SEQ ID NO: 20612 - DNA, 210 bp, Homo sapiens
ctgctggccacctgctgggggtctgcgcttgagtgaatgagagagagagagggagggagcaagagagagggaagctcatggttgtttgaattagtggtttcccatgtactaaacactttgagaaaaagtgcagggattctgaaaagacagatgtacacgctcccatacaccctggcctgatttcttcaaggttgcagctctagccacttc

SEQ ID NO: 20613 - DNA, 404 bp, Homo sapiens
tctcgaactcctgatcccaggtgatccacctgcctcagcctcccaaagttcttggattacaggcgtgaaccactgctcctggccgaacattatattttttaaaagcaaatatttagaataaagctcgttagtagacctttattcgttgatttatttcatctttcctggagggaaaaatatgtaacatatacatatgcttttccagaataaatcagtctttttggggatactcttaggctgcagatcagaaagactgctttagaaaacaaaacaaaaattccagctacttaaaatgtataagaatctggcaaagtttggatacagtggatagttgttcaaaagaagaaagctttttggagatgaggttagaagaagagttcacaaagtgaaaatttaatgggctt

SEQ ID NO: 20614 - DNA, 1571 bp, Homo sapiens
tcaaccatgacatttcttgtttctaaagccacagcctctaaaattgaatgttaagtcaactagaaataatgacaatatttaagaaataaaattctttttattttttatagtttataaaaaattatttttgaattataagttaaacaacttgaacatgcagatacctaaaagtgtcatctaggtgatagtattaatattttaatagcttataattgtgagtcacagttgccccattgggtttactgaaaagcagttatttatcttatatgtgtgaatggagaataggctttttataatcctaagcatacagatcttttaagattagcgctatatttagatctgaataaaattgataggcttgtaataacaaattttaatacttttttctaatagaagtgaaaaacagaagtcatttgttaaaatgagtttaagagaaacttcacatgtatttattaaataacacttaaaccacatggtaagttactaatcagtaatttcaatctattttattttagtcactgaaaaagcataacattctttaattattcaatcagaaacagtattcttattagtgtttctgaaagcaactgtagaccactcagtggatgacaaggttcatgctgacaacaaattttctatataataataggctcattttaactttaaatataaacactcattatttcaaaagtaaaattaatggttcttttaagtcataagaggaataatgttataattcacttactgaagtgtttgtctcagactttgtaatgaatactttaaaccagaaattaagttctacatactatctatggataaaaagaagtggtttgtaaatttatctttatttttactaaattaaaaaatttaaagccaaaatgttaggtcaggatttaaaacaagcattgggtgacagggtgttgggcgtaatggttagattgaaactcggtgtcagctggttactgattgcatccccaactttaggattttggtaaaattaaagcaattaatgcaaataaaggtgcccgaagagcacccagcatatagctctcatttgttgattctgttagatcatgatcaatgttaagcctaaaaacaaggtggccacatcagtggtttgtaacccatgtttattctaatcagtcaatctggggctatatataatagtagttgaatgtttatagtactacccttggaaaattcccatatattcacacccagcatggatataaatacgggaaagatttcccattgagtacttctctttagcactccagtaacactagacaaataagcacctaaatgccgagtgtttgtcagttttaaaattagaaaagaaggcaagttgttttcttgtctacctgtttaataaattttttattgccaagtacgtatgttcatttgatttaatacgttgaaatgtagtttaaaatatatattcaaataactaacaagtgaaggaataatttatttagaaacgtagaaataatggtactgtaagcagttgctttagagtcttttatagtattgtattttgaacattaaaaataaacattttattcctgaaaaat

SEQ ID NO: 20615 - DNA, 510 bp, Homo sapiens
gaaaacagaacagaagggaatgtcttatctgatgtcgacagcagacaattcaatggagacagacttccctccccaatctcagtaaagaggtggttattttacggaaagaaaaaggacaccagaaacagaagaaagacacatctccatttacttgaaaagaaaaaagctgaaaagaacctttgcaataaaaaagtgttataattttaggcatgcaaacctgtgcgttcacacctttccctacggcagccctttctcccaggttccaggagtagagcccagggcgcatgtctgagtttgtctctggatactagtgtcaaacacctggccacccgtgagcacagctcacggaggaggcagagcaacaggacaaacgggtatctgaagatatcattcaacagcctagaatcacactggtccttaaaggagaaagccttccagtttcctcggctcagcttttcccaaacttcatgcaccacctttgtggcttctgccacattcaaagaccaccta

SEQ ID NO: 20616 - DNA, 421 bp, Homo sapiens
ttcctcgctaagcggtttgagatcctcaagtgtaaacaggactctccctggaggctgctcctccgggcccctccccgcggcccgaccgtcgctcgcttctctccccggacggcggccgcctctgttttctcgttccctcccctcagctggctttcagctttcttttctcttcatcgtccccttcccgcatacacactgaaagaatctcgaattcctaaaaattagaagcggggcaggactagccttcgaaaaagccgaggctgggcattgcatggcattgcgtcgagctgtcctcgccctcatcagctcccttccccggccccatccgttcgcccttgcctctcttccagccttcctctaatttccccagggaacctgcggagtgtcgctttgggaaattaacgcggccggggtttggggg

SEQ ID NO: 20617 - DNA, 4051 bp, Homo sapiens
agagccggtgccggcccgcgagccccagcgtctctgcagaccagtcccctccagggtccggcggggcccgcgcggtgggaggagtcgggcactggccggcgactaacgggtccgactgctgaccaagctaggagagacccggaccacggagacagagaccccggcatcgcgacccccgaggacctcctctcctcgccctgtggcacccactagtcctgggcactcagtcgcggagagcccccgaccccgcgcgcccagccccgggggagcccacctcctccccgcggcccgcccgggccatgctcccccggggcagcggctgagccccagccgggaccgggatcggagcccgcgcggagcatggatccgggctgggggcagcgggacgtgggctgggcggccttgctgatcctcttcgccgcctcgctgctcacggtgttcgcctggctgctgcaatatgcccggggcttgtggctggcgcgggcccgcggggaccggggcccgggacccgccttagccggggaacccgcgggttccctgcgggagctgggcgtgtggcgctcgctgctgcggctgcgggcgactcgggctggcgccgccgaggagccaggagtccggggcctcctggcgtcactcttcgccttcaagtctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgtcgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttaaaaactggacaactggttatcctttgaaaggcagtaggcagccaggctgtgacatggatggtgtgggaggatgagacaggggcccggataatgaggttgggtagatgacacacattgtggatctgctaagaagttcctgcaggaaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcatttggttgtggatgagaagtaaatgaagtgctgagtgttaactgttgcctcagaagaaactgggagggggaagtcttagaagtgtttcaacataataaaagctctctcattctgaaatgtgggcaaatttcagggattgatagatcctagcaaactgtgtccctggttcccgtgcttgagatcttatacaggacttgaaccaggtaagctgctacaggatattgggcagaatgcaggaccaggaagcaagaaaactgagtctgccacagacaa

SEQ ID NO: 20618 - DNA, 3341 bp, Homo sapiens
agagccggtgccggcccgcgagccccagcgtctctgcagaccagtcccctccagggtccggcggggcccgcgcggtgggaggagtcgggcactggccggcgactaacgggtccgactgctgaccaagctaggagagacccggaccacggagacagagaccccggcatcgcgacccccgaggacctcctctcctcgccctgtggcacccactagtcctgggcactcagtcgcggagagcccccgaccccgcgcgcccagccccgggggagcccacctcctccccgcggcccgcccgggccatgctcccccggggcagcggctgagccccagccgggaccgggatcggagcccgcgcggagcatggatccgggctgggggcagcgggacgtgggctgggcggccttgctgatcctcttcgccgcctcgctgctcacggtgttcgcctggctgctgcaatatgcccggggcttgtggctggcgcgggcccgcggggaccggggcccgggacccgccttagccggggaacccgcgggttccctgcgggagctgggcgtgtggcgctcgctgctgcggctgcgggcgactcgggctggcgccgccgaggagccaggagtccggggcctcctggcgtcactcttcgccttcaagtctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgtcgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagttt

SEQ ID NO: 20619 - DNA, 414 bp, Homo sapiens
aatactatattacgtcagtcaacttacaaacaaatgttcatccttgctagtgatcaaagaaatacaaattaaaacataggctttcgtggttacctcatagcctggccaaaatggaaaagatgaactttcataattttccatcatagcattgtttataataacaacacatgggaaacaacacatatgtctcattatggtatatccatttattggaatcctaccacctattaaaaatgatatgagtctagggccgggtgcggtggctcacgcctgtaatcctaacactttgagaggctgaggtgggtggatcacgatgtcaggagatcgagaccatcctggctaacacggtgaaaccccatccctattaaaaatacaaaaaattagccgggcatggtggcatgcgcctgtagtccc

SEQ ID NO: 20620 - DNA, 872 bp, Homo sapiens
aatcccccacagttccatttattaaataagtaaaccccaataataagcatttgtgtcctggcaacttatagtggatgtctagaaaagtaatacataaagagaaatgttcatgttatttgtttagtcatgggatgtgtgtgcctgtcgagcacctcttcaacttggaatctggtagaacaccgccaccctcattgcctcatttttccacgtcgaccttcacagtaattgcttgttcagtgactgccacaacccagcctggcagagagagggaagataccctataaagcaaggtaacgttaatgttgagaccatgaatggccttgagcagagcagagtatcattgcttccttcaaaattcagaaggatctgatggtgctctgtgagttcatgggggtgcctccgtgcaggttggaaaccacagctgtgcgtccttcccgctttccctcttgatcagtagaagggtaccctccctggcctgcacgtcgctgggtcacacaacactggctgtcgttgcacaaagccacggccaccagcgttcctttgaggccatttgtttccagccatggtgcctataggatttttcctttatcctgtaatttcagccaaatcagagcatgtgacctggcttagatgtcaatataattgttgttatgtgctcttttcccttcctgtgtctgtgacaggtttaatttaacctgagaaggctgcagatcctcggggttggtgtaaaaacacctcatcctgatctgagaaggcggtcagcttttctcctcgttgccgttggctgccagcacccattctctgtggatgtgaaaatcccagaagggctgggcttccttcttgggcattccccaggcctatctccagagtgg

SEQ ID NO: 20621 - DNA, 734 bp, Homo sapiens
gcttggaaattgtatgaaattcagacttcattgtctatgaatttttattgggactcagctatactcatgtatttatgtattgcctgttggtactttcacactacaaaggcagagttgactggttgcagcagagactgtaatggcctacaagcctaaaatatttactgtgtgactctttacagaaaatgtttgctgatttctgatagagagttgatgaagagtaagacaaaaatgtcatataggtgaatgcagatcttgtgatcttacagttgtgaaactggaacataaaacagtttgtcggtgggctttattaggtgacattgtgaaacttctgatgacagtcttgcaggtacttaaaaaagtagtacaacaaagtgagtaattcatgtgcagtccaggggaaaacttaacagatagcaaaagaaagtatatgattaaaaaattcaaataggccgggcacattggctcacgcctgtaatcccagcactttggaaggctaaggcgggtggatcatgaggtcaggagttcgagaccagcctgaccaacatggtgaaaccctgtctctactaaaattacaaaaattagctgggcatggtggtgcgtgcctgtaatcccagctagtcaggaggctgaggcaggagtatcacttgaacccaggaggtggaggttgcagtgagccgagattgtgccactgcgctccagcctgggcaacagagtgagactccgtctcagga

SEQ ID NO: 20622 - DNA, 966 bp, Homo sapiens
gctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagca

SEQ ID NO: 20623 - DNA, 2811 bp, Homo sapiens
gctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagcca

SEQ ID NO: 20624 - DNA, 2863 bp, Homo sapiens
gctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaacttaaaaaaaaaa

SEQ ID NO: 20625 - DNA, 2753 bp, Homo sapiens
gctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagtttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagcca

SEQ ID NO: 20626 - DNA, 2081 bp, Homo sapiens
  misc_feature (2081)..(2081): n is a, c, g, or t
gctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacatcctctgatgcagtcaacctttccaaagtgttctgaatggacgcttcatgttttggtcccan

SEQ ID NO: 20627 - DNA, 399 bp, Homo sapiens
cagcatttagtagcctgggttaccttgggcaaattacttaatcatactgtgctttgattttctcaactgtgaaatggggataataagcccaccttaatagtcaccatatggctattatgaggaacatataaattaatccctatagtagccactgtatggctattatgaggaacatataaattaatacctataaacctttaggatagtacctgggacaaggtatagttatttttagatacattatcttagaattgaggttacacagacccaattctgtaactatgggttattcaggtatttacgctaaaatgatagttaaaatgcttggacatgaaaaaaatactcatggaaaaagtaattacaaaatatttagaatgatgtgaataatgccagatcttt

SEQ ID NO: 20628 - DNA, 325 bp, Homo sapiens
cataaaattgctgtgaagattgcatgatttaatatgcacaaagctcttagaaggatgcctggcccacaaatatgcattcagtgcacatttcttgctacagttctgctaatcctataaaacatatgcactatgatggatgtgtctgggtgccaggaggacacaaaggagcactaactcatccagaccagaagcttcccagaggaggtgattcccaaggtgaaatccgaaagataaagggagtgagttatccaggagaagagaaaggaaaagcatattccagacatcaggataggacagtggaggcaaaacagcatatgctatatat

SEQ ID NO: 20629 - DNA, 496 bp, Homo sapiens
cttttattagctaagtgtcatataagtaattcacagtattacactcttgcttgtgtgctttctctctctctgttttagaacagtggggttggatacggtaaaagcaaggaatcggaatcgtgaaattgaatatttgagaactactttattcaatttagaactttcaaataaattggtatttagataaaatagaaataaacacaagctaaaatttattgaatgctttctatgtgccaggcattgagcttcccatgtacctagcactaagtgtttgtactgtaggattagtgtgctttaatcatggttctggtgtatgagttgtggcaccttggatctcacatttctcatctataagatatattatacagggttttgtgaatattagatgagataatatgtataaaatatttagcacagtgtctgaatatggtaaaatgcctgataaattttagcaacttttattaccagtacttgaattatcttatttaatcatcag

SEQ ID NO: 20630 - DNA, 572 bp, Homo sapiens
gcagcctatttgctgcatgaactgtgcccgatgcatgcccaaggacaaggctattaagaaatttgtcattcgaaacatagtggagcccgcagcagtcagggacatttttgaagcgagggtcttcaatgcctatgtgctttccaagcagtatatgaagctacattactgtgtgagttgtgcaattcacagcaaagtagtcagaaatcaatctcatgaaggcttcaaggacccaacactcccacccttagacctgtgggtgctgccccatgacccccaccaaagcccatgtaaggagctgagtccttaaagactgaagacagactattctctggagaaaaataaaatggaaattgtactttaaaaaaaatggctcctactgactagtacaggaccttagaattgttaatgaagctgttattcctattcatcctattgtcccaaacccttacactctttttggacaaattctctccatcacagcttggtttactgtacttgatcttaaggatgcctttttctgcattcctgtacacccagatagccaatttttgtttgcttttgaatagcaagac

SEQ ID NO: 20631 - DNA, 319 bp, Homo sapiens
tgtggcatcaagcttgcatgaatcaaggccgctgctggggctagcccagacccgtagtgggtttggtggtggttgttactgcagagcgtcccagccatcctgactagtacagcgtggagtgtgtctatgtcctggagcttggggagagtcctggccgcagtccaggctttgaagaatgttgacttgacctggaatacccacctgtccctggagtgctgtgttcttaggctagttccgtaacctccctgtctgcttcttcatctacacaccatttgatcttccttaggtttgctgtaaggagtaaatgagataacgcatg

SEQ ID NO: 20632 - DNA, 1655 bp, Homo sapiens
agaggctgtcggactctgactgcgcggagaccgctggactctggtcgcggccttagtccgctgatcctcgcttgggtgcccgcccttagcggcccggcgttgaattccgggaagtgggagcttcaggctcgctccgtgcgggtatgggcgctaatgtcacttgggatggttgcgcaaggacatcgcggcggacactgacaaggaaccggggaggaacgggggtggggagagactgcgatgggactcgggaagccgggaagggccgcgctgaataagcctaaggggccgggtcgcaaggagtgtcgggtagcacaggcctcggctcagtcggagcgccaggcctcagggtccgggcgggggctgctgcgtcacaccaggcagcctgggaacgcaactgttgggcaaccgtggtggcctctcgccacctcttacgcttgggcgatctgcgattgacgcatcctgggagctgatgtcccgcacgggcggggcgccggaggaggagagaaaatagagacccggttgttgacagcctgtgatgccgcttgattcatgtgtgggtggcctggtttagaaatgtaccacccttcctttctaggttcctccccggagggcggggtgacgggtgcggcgccgaatcgcaacaaaaaacgctgctcgagggatgttagtaactgtctcagcttaagttgctgccttttagcttacagtttgtatcgtaactgtaattgtggatcttagttaaatcccttcagtgtgttggaaacatatttttaaggtgtatttttgaaacatacttagagcattttgaaatgcttttttgaaagcgttttttaaatcaaaattctgttacactttatttttttcagtctgcagatgaacttgactcactcaaggttaatgatttttgttttttatttatgtttgtagaggcggggttttgtcatgttgctaggttggtgttgaactcctgagctcgagcgatccacctgccactgccttccaaagtgctggaattacaggcgtgagccacggcgcccggtggccgaggttaataataattaaaagtttctaatcccattgttcagttatttgatttggtgtaaaggcgcactttccaagtcagatgagtttgtggtaacatacattccccaaataattatttttcccttgtgggaaatattccagttttaggctaccagctgtttaaacagtttggttcaaatccttcaaaaaaatctcaaaacataactccacatatgtatttactacatattgaagggtgtattcacttggagaagtaggagaaagcaaacagatgccaatggcctttttgaaaacatgtatctatcagcaataattgaatagcaaaacgaagtggaacactaccatcctttgcaatattagatagttttaatactgggttgtgaggaatgaaaagatcatacaaatcgtcatttctgaagtcatttctgaagtcgtcatttctgaactgagtgctaatttttcatattaagctttatgttaatatccttaatgagaggaacttcctgtgcccgtaatttctccagagaaactattaacatacacagaatgttgtaatcagaagtatagttcagttaataaagtcctcaattacaactctgaaaaaaagtcat

SEQ ID NO: 20633 - DNA, 192 bp, Homo sapiens
gcctgagtgataaagtgagaccctgtctcaaaaacaaacaaaaaggcagatactaacacagaagaatattaataatgcacttggcaagcaattaatgaccttaaaacataaaaataagcaaaccactagtatgaataaccataataggtaaaaatcaatatcagaaacattaagacctccatagataaatgg

SEQ ID NO: 20634 - DNA, 388 bp, Homo sapiens
gctatatgctgtattaggggaacatataagctatagtataatgtattgatcattagaatccagggcatgcctaaattatatctatggaaaagcagagtaggcggcatctgatctgccttttttctgaagggaagctactgagaggagatgataccaaaagtcccatttgaaatccacatgataagcaaaaccatggatcagtttgcttagggagaattatgaagaaagagctccatggccaggctgtatcttggaaaatcaccacaggaagtaaaagccagtcagggaacaatgaagagggcagaaagagaaggagaatattgtcctgtaatggaaacaggaaggatattgaaagagtcaggggtgatcagaaccggagcaagtaagt

SEQ ID NO: 20635 - DNA, 1235 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagta

SEQ ID NO: 20636 - DNA, 1170 bp, Homo sapiens
caaagcccaaaatttcggcacaagggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagta

SEQ ID NO: 20637 - DNA, 1107 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagcatattcctccaacacaccctccatacctctgtgtccctgatggcaactataggagtggctggagctacatcaaactgtgtccatcatttgagtgtcttactgaaacctatgctgccctgcccttcaacagaaattatgacaagtggtggagacagataacagagaagaagcaagtcagaaga

SEQ ID NO: 20638 - DNA, 1070 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagaaatgtctgctacagagacaaactgaagtttgtgtatatcgtgctgattcagaagagaatgaaggcatttgtcaagagataatgtcagactaatcagacatgttccaatcgattaatgcatttggaggatttccaaatatttgctg

SEQ ID NO: 20639 - DNA, 1296 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacaggcatttggattgaaaggatggaaagatggccgtaggaaacaagtagcttactatgtaggagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagta

SEQ ID NO: 20640 - DNA, 1074 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgtcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagta

SEQ ID NO: 20641 - DNA, 1280 bp, Homo sapiens
agcgggccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgttggcttttttcccggggccaaaccggaaggccttggggctggccccggcaccgggccgttttcccgtccaatcggtcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagta

SEQ ID NO: 20642 - DNA, 350 bp, Homo sapiens
ttgagacagtctcgcattgttgcacgggctggagtgcaatggtgcaatcttggctcacagcaacctccgcctcctgggttcaagcgattcttctgcctcggcttcccgactagctgggattaaaggtacccgccaccacgtccagctaattttttgtgtttttagtagaggcgggtttcactatgttggccaggctggtctcaaactcctgatctcgtgatccaccctcctaggcctcctaaaatgctgagattacagacgtggttaagtaaaactagcatttcttaaactgcaagtgtgtggtggtgaggaatccagctattcgtggagtttgtaccaccgccccaact

SEQ ID NO: 20643 - DNA, 413 bp, Homo sapiens
tgagttgagtacataacaaggcaaggcagagagtgagtgtgtttatgttttcagatttatttgatcccaccacttgaaaaaaatgtgaatttgttaccaaaacaccaagcgtttggtctaggtcctgctgcttgccacacagaaagccagtcactgagacaatgagttttgtcagcagaaaggctttaattgggtgctgcgcctgaggatagagatcagtcttaaatcctcactgaccaactaaaattaggggtttatatagcagagaagaaatgtaaccacgcatgggaaaatagggaggcgcaaggaagaggatttggttaataggaagcaggtggttgcctaggcagttatggtaggtgagtggtctgacatctcattgtccagatacagtgatctggtaagtttcagat

SEQ ID NO: 20644 - DNA, 717 bp, Homo sapiens
ttttttcacattcttatccaatctgatagcaaaaactcttggctttaccttcaaaatatatctagaatcttattgcttcttaccacctccactgtgctactaccttaatctaaaagccactatcttctcttacttgtacttttttactagactctgtttcctctgttaacgtctttgctttattacagtctcctttcaacatagtagcctgagtgacccttttcttttcttttttttttttgccagacagagtcttgctctgtcgtctagggccgagattgtgtcactgcactctagcctgggtgacagagcgagactccatctcaaaaaaaaaaaaaaaaaaaaaaaacattgtttgtccatatacttaggtttgtaagaaattgagttattctgattccttgctaaggccttcttttaaaagcaagatacgccgggtgcagtggctcacacctttaatcccagcactttgggaggccgaagcgggcagatcacgaggtcaggatatcgagactagcctggctaacacggtgaaaccccgtctctacaacaaaatacaaaaaagaattagttgggcatggtggtgggtgcctgtagtcccagctactcaggaggctgaggcagaagaatcccttgaacctgagaggtggaggttgcagtgagccgagattgcgccactgcactccagcctgggcgacacagtgagattcagtctca

SEQ ID NO: 20645 - DNA, 514 bp, Homo sapiens
ggatggtagaacgaagtggggcagtttcaatgaaagggagcattaagctgagctctgcctctttcctttgtctgcatgtctggtaaacacaacttaatggattgtgcctcctccttcccccagtatactcccatgaagcccctaaagaataagtttatcccatagcaatctatggtatggtgtcatattgggagtcttgagctgaaaagtactttctcacggtatattgacgcaagagcttccagctgtccagagcgcaagagccagcgccagtccccagagggttgctatgggaacactgttatggcaactggttttcatcacagactctgcagttccattggctgaactataaccacacgctagtcctttaatggttaacagtaactttaaaatcatttgaaatttaaaaataatttctggtggtgtggaatagctagggagggcagtgtggccagccgcgcagctatggtgtgagctgaccccattcagaatattgaaaaacatgctcatt

SEQ ID NO: 20646 - DNA, 423 bp, Homo sapiens
aatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactc

SEQ ID NO: 20647 - DNA, 412 bp, Homo sapiens
atcagagaacttacactgcatgattttcttctttttctcaaagtggcactgagtgcagctaagctgttacacacttgatgtaaaatttttccatttaaaaatcacccatctttaaaaagggaaaaaatagtcctggcattttggggaaagagttttctctgaaggaaggaggagaaaaatatggagaataatgaattcatcaagctgaaaatgcacgaagcagcgaagcgctcaggcttcaatacatggcaaatggaaagagagctcccattactgtcgagatgcacagacacagccccgctaatcgcttggtcatgcttgggagacactaagtcatcacaggccatgacatggtgagaacagggtgccaggggtttgttgtaagaaaaaattgtttatttaacatccataa

SEQ ID NO: 20648 - DNA, 421 bp, Homo sapiens
gattattctacatgatgtacttattgacataacaacctgaaattcttgattttagacaatttctcctcaagttgattcagctgcatgactctcagaaatcagtcattttttattgtagattgctggttttcttcctctagtttgtatcgtgtattttcctcctgtggagaaaatgtggttggcaagaaatgccatattttaaagctgtatcgtggctgttaatgcagaaaacaccagtgtactgcaggctgtttggcagtggggctggggctgagtgtcctgccctcagtggcctgtgtctgtgctcttgttcgctgacatgcagatacaggggcagatctgagggtttgatggagtgcagaaggccacacgtgtggctttctgtaaatgcagaaacatggaatccttgagcagacacttg

SEQ ID NO: 20649 - DNA, 513 bp, Homo sapiens
atttaagagagatattacagtggctggtgcctgttagaatatctatagatgctttcctcagataaaattttagacctgacagaaggtgtctatattcattttttattgtgtgtacaaattaccacaatttagtggcttaaaataacatgcatttattatctcacagtttccgtgcatcaggagtttgggcacagtgtagttgagtcctttgcttaggatctcataaggctgcaataaagctattggccaggctgtattatgtagaggctcaattatgaagaaatctgcttccacacttattcaggtcattggcagaattcatttccttggagctgtatgactgagggcctggctttttattgactgtcaggtgaaagcctctctcaggtcctagggattgcctatagtttccctgctacatgactgtctccatggtggtttgcttttcaaggcctgcaggaaagcttcttactccagtctgctcatactgtattctataatgtaacataatca

SEQ ID NO: 20650 - DNA, 339 bp, Homo sapiens
attagacgtagagctgagacttttgaaaaacaagctcagaatctcatcctatgaatggttgaattacaaggcaaattgaattcccaacctcacagcatgtatgctctaaactaaggacattgtttgggaaaaaattggatatcaaatattacaatgggaacatatgggaagattctgatgaagcagaagacactgaacccttaaactctgctgagtctttttgccaatagtgacagcgatctaccccatctaaattgactcaaaatgtcactgtgatctaccaatcagaattggggcttctgaagttcacacgatttatagaattgtagctcaggctca

SEQ ID NO: 20651 - DNA, 869 bp, Homo sapiens
agtgtctagtgacgtgctggcaagtacaactggctctgtggggaggcggtaccctgatttgtaccttttgctgatttccattgagtaaatactcttgccatgtttgatttcaagctaccaacatggtgtcaattggctcacagaagccctgaaaatttaataatcagctcttatgagcctgtacaaactgaacttgcattctgctaccaatatctacttttgaagttgtcagtttagattggaagatacataaattgccatgcagtctgataaagacagaaatagaagtatgtagaaggtagaaaggtatcacaagggacactggttcaattctgcggtgggcatatccacatggtaggctgcaaacaaagacaggcaaggcctgtaggtgggtggagacagagaccttcagagcatcctcagtgccttcaggtcatggggaaatgccttggcctgccttaaggtcccgtgcagtctagcctcaccttacctggctgaacattctcccacatttactgacacaaaccttctgctctagtgagtccagcccagtgttttcagtcttgagagcacatccctgccttggctgacacccacctcctcccaccaccgtttagaaagtgccttccctccacctccacttccctgctctactcatccttctttatgaatgcttcctacaacagctccaagccacagaaagcactgacagaaagggaaagattgatcacgtgaattccattaaagtgaagaatttatgtttatcaaaagtcactgttaagaaaggaaaaggcaaacaatggagtcagaggaactgtttggaacacttatgaccaatcgaggatttgtattcaggacatgtaaggacc

SEQ ID NO: 20652 - DNA, 412 bp, Homo sapiens
acccaaaccaaaacagtcaaccagtggcaaaagaaaccgtcctgtttcccaggtaggaaaaaggaaggcaaagcaccccaagatgtgcttttattttaaatctccttgatctgaccaatcgggtgagctggaacctcacggctgagccccgagtccaacttcttccccgccaggactactcactgtggccaggcccaagcgcatgtggaacacacgccaacacaggacaggctcagcacgccggccgcttccctcggggaaaggcccgccaacgagtccatcgcgtgggagaacagtgggaaagggtcgcggccccggccgtccgtaaagggacccgactgccggcgcaggacgcgaaccaccagcgccgctccgccgccatgtgccgccgctcctccggtccgagattatg

SEQ ID NO: 20653 - DNA, 231 bp, Homo sapiens
gacacttttagtgtcagggtgaccaggaattgtggctgtaaaggaagcctgagacttctctggttctggcatgaaagaattttccaaaactatgtagacgctggggccttacaagtttgatattagtgtaaacaaatgtattctcaacaagaatatagatgagtttgcaatgaatttcagaatacttaactccaggcttataagagattaaataattctttaaaatggatt

SEQ ID NO: 20654 - DNA, 279 bp, Homo sapiens
agaaggcacttctttacttctaattcttctccactgcccaggtaactgatattctcaagtgggacattgtaatttgtttaattcatttaaattgatttcatataattgggagataaagattgttcagttgcaagacaaagtcttaacttgaactctcaggacacgggtgggtccctaaactcaatacgtgagtgttgctgccgggctgttgggccatcttccacccgccatagatcactttcttcatcaaagaagaaggaatatttagaaactggtagt

SEQ ID NO: 20655 - DNA, 452 bp, Homo sapiens
gttttgagttttatctaaagactgacattgacttgaagttgggctttccagattcaaatatctgccccagatgagatttagatgcagagggttagtgtccttttccccagggggatggcgtgatgatttgttcaagattgtgttatagtagctgccccttttaagccagctgtgtgtgtgtggtggggggtgggcagtgtgtattccacatcaacatcctagaaagaacgaataaacatttagtgatctcactgtttctacttacatttggtataatgtactgtttttattggtgctattacctatgttaatggggcactttacaaaattttcaagaacgtttttattaaaattatttcaaagacttctttcttaaaatatgattttaccatgtaaaaaattatactaaggtagaagaatattcgttctttctcattttctgaaaaaaaaaa

SEQ ID NO: 20656 - DNA, 773 bp, Homo sapiens
gcatgctgagtagtgtcatgtcaagggggcaagggtgtgctactgacatctagtgggtggatgccagggatgctgctaaataaacatccttgagttcacaggacagctttccttcagccccctaccccaccttccgcagaaagaattatctggtctaaaatgagtttgagaaacacaggtatatactgtgtatttctttttccttgaaggagggatcgcaaagaagtgagtctagcctgtttattttctttttcatcttgctgttggctgactacttggttttcttacgtatatgtctatattttccaatatctcaaaaataggcacaagagaactgaaggtacttaattttataaaaccaaaagaatactctgaacagttagagggaaaagagggtaaccaaaatgtgtaagggccttacacacagagtggtatctcaaaatatttgtttgtggttttacacttctaagattaactgaatatgttcattaagttctaatttttgttttgtaattcctatcaaatcttttgatgctttatgaactgcattggtgtactgattcattgaaatctaaaaagaaagctgctactgataagattgacaggaaggaatctatctagctagaataaactacgtgcaaagtaaagaacaaggagtccgtgatctaatgatttttgtgaaagattctgacttgagggtttaatttccaaattggtatgcttctcatatgcgtgatcttatgcatattaaactttgttgtaatttcatagtt

SEQ ID NO: 20657 - DNA, 406 bp, Homo sapiens
tttttttttaaatctcttactgtccttgtcatagttctagcttctgtgtcccctactcaattcccacgtcagtagtatgcccttcgttttaaatttaaatttttgtcccaaatatttttttaactaggaagaaattcctatttcaccttagtcccaattgtggtatttgtagctagcactgtaattcatgctctctgcatagtaaacatatcataatgtttcatcactgcacagaaatcacttgatctgaatcaatctattgtccctgaatagaatagcgatgtgtttgtgtgtgatactagaaatgacacatggccctgacgtgcatgctgcgatacaacaagaaagtgaagtattatctcaccatatcaataaagttgtgcttaatggaaaaataaaaaaaaat

SEQ ID NO: 20658 - DNA, 390 bp, Homo sapiens
tcatggaagaactcactgagcagttggaggcaagagcaggggtctagctgctggtgaagacatccttaatcactggatgggggtaagccaagagtgaatcttattctagtgtatggagcagtgttaggaaatgttcagatagagctgtgtcttaaatggctcatttattcatatgttctttcaaacatttattcatttactcacaaatgcttactaagtacctgctaagtgtcactagtatgtgtcttagatatcgaaaagattctgcagctttcctcagtaaacatcgactctcagtcaatgttccttgatatgcagacatgaataaggaaggaatcgtaccccccaaaggtgggtgcaagccaaccccatggcctccatgactttttc

SEQ ID NO: 20659 - DNA, 312 bp, Homo sapiens
gccttccgaaatgctgggattacaggcgtgagccatggcgcccagcctatctcttcctcttcttatagggacatcagttctatcggattagggcccacccttatgacctctgtttaacctttattacatacctcaaggccctatctccagatacagtcatgttggggattagggattcatgaattttggggacacacaattcaacccgtaacagatacctactagtctcctggcacttgcgaaacccagtggatggagtataaaacaaggaacgtaatctaagtagggctataaaatgtagaaaatattggg

SEQ ID NO: 20660 - DNA, 433 bp, Homo sapiens
atgtttgttgaatgaataaattttcaggcctgcctgaaatatctatgtgacatgtgtcgacacatacagcccctctggtactcagtatcatattctgaaaaatgaaggtgttagacaaggatttctagcaactgttttacttctaaaattctgtaatgtggtggtggctcacacctgtaattccagcactttgggaggccaagacgggcagattgcttgagctcaggagtttgagaccagcctggacaacatggtgaaacccagtctctaccaaaaatacaaaaattagccaggtgtggtggtgcacgtctgtggtctcagctactgtggacactgaggcgggaggatcgcttgaggcctgggaagcagaggttgcagtgaactgagatggtaccactgcattccatcttggccaacagaatgagactctgtc

SEQ ID NO: 20661 - DNA, 738 bp, Homo sapiens
ctgcctcctgagtagctgagactacaggcgcctgccacgacgcctggctaattttttgtatttttagtacagacaggatttcaccatgttagccaggatggtctcgatctcctaacctcgtgatccacccgcctcagcctcccaaagtgctcggattatgggcgtgggccacggcgcttggcccacccctgcatttattgagttaaattttaaaaatcctatcctaggaaattggtggtggggctcagaaaatgataccccaaagtatgaagctgtgggaggctgaatgctttgaactaaagtatctgaccatcgctcactccttttccctcccaaaaccctcctgaagcgcagggaggggccttctctgatgttctcttttgtttctaagggaagttcctgcagaaggaatgccattgtcttgagccctttccctagcatctcataaaacatggacaattaactcacaggaaaggatactgaaggtgataccatctcttctgaggactgggctgcttgagaggttttatctgcatgacaagacagcctttgtttgccatgcatttcctcccctcaacctcctagcgtctgctgccacctcctcccagaaacctcaggccccagtttttggagctcaaatgctatttagacttcatcagtctggcccttactagagtctcacattttgtgggactcctgtgcatgtatgtaataaatttgcatgccttttctcctatt

SEQ ID NO: 20662 - DNA, 705 bp, Homo sapiens
catgtaccaatattaggatattgagtgacagtgtgtgagtttagctctgcctaatatattactgcttgtgggatctttgggagactgtatcctctttgagattgaatttcttctataaaatgagcataatactaccttacttaaatttaagggtcatcatgaagataaatgtactacatttataaacagtaaagtactacaaaggaccaagcaaatacgaattattttttgcagtggagaaacaagcgcccggtgagaatatatgacctaaggttctgtagtttatgacctaaccaggcccagaatgaagtttttcatatcctagtagtgtgttttttctgttttgcccaaaaaaccgcatacctcagagaaggaaaaaagtgtgaattgtgggtatattggggttatcagtgtgcttctgagggaagacaggcatcactacttcccagagatgccctggaaatgatatagaagatgctgaagaattcaacgtgataacagaatgaggcatttgtagtaatgctgagaacagaaaaatggactaagtggaaaatttgtttgcatgtctttgaatgtagatttgttatgtgaacaaactacctagtttatttttagttcaatacaataattgttttaagaaaacatgaaataactactcaatataaaatgcattttaaaactcctattaaaaaagatcacaggaaa

SEQ ID NO: 20663 - DNA, 372 bp, Homo sapiens
atggctcacaaagggcttccctggttatttacttctgactcttgaaagcttaaagaaattgtgcctgagaggttcagtaccttgtccagggacacccagtttgtgcagagccgggaggaaaacacagttcagttcactgtcacaggtgagtcaccaaaaacatcctataaaaagaccttttgagaaactgtaaccccgttaaaactagttaaaaattcttgccttaaagcattccatattcattttacttggctttctgtggattttctcccatgagagacaagcagtattaatcggaaaacggttaagtggtgcagcctgagtgttttgctgtgttaattttaataaaagaacagtgccttaaaaaaaaaa

SEQ ID NO: 20664 - DNA, 436 bp, Homo sapiens
gcatactttttttttttaagatggagtcttgctcttgtcgcccaggctggagtgcagtggtgtgatttcagctcactgcaaccttcacttcctgggttcaagcaattctcctgcctcagcagctgggattataggcgcccaccacaacaacaccagactaatttttgtatatttagtagggacagggtttcaccatgttagccaggctgatctcgaactcctgacctcaggtgatccacctgccttggcctcccaaagtgctaggattacaggtgtaagccactgcgcccagcctacccttttccactctattaacacagggtcacccaaaagtcttccctcattggttcccagggtactgatctctgctggctttttgcctcctcctctaagctgcaccctttctgtctcatttactgattcccttttcttcatc

SEQ ID NO: 20665 - DNA, 470 bp, Homo sapiens
cacacttattgatgaactgctatgagtttttgatgatggcttggctagttgaattctgattcgatactttataattagggctcactagtgacgagcaaaagcccgtgaaactgtctttgtttatgatcccaccacgtatctctactattaaagaattagcctctgggccgtgtgtcctcctggtctacctccagcacaaggacgttcctcagagcaaggcatttgctcgctccccttgctccttacacacggccttcccactcccagctaacacctgaaataggatgggatagtgcacactctgaaggtgaagctttaggtgacgtcgaagcatccagccatatctgtcagtttatataaggggtggcggctgctcagcgaggcctcaggagtgtgaaggaggcttggctggcggaggggccgtgctgctggatcagatggcggaacacggcccagagcaactgaagttc

SEQ ID NO: 20666 - DNA, 3893 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20667 - DNA, 3854 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggcca

SEQ ID NO: 20668 - DNA, 3723 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20669 - DNA, 3838 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatactttttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20670 - DNA, 3748 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgta

SEQ ID NO: 20671 - DNA, 3939 bp, Homo sapiens
gtgcctaaagtggcatatgtgggtcacccttctagaggagctaactagagtcctaactaatgggatccagcagggccatttctccagagggccagtatcctattaggagactctggaattcttaggttctactcaagagtggaaggaccaatcacctctgatattctgtggaaggtttggggtcaaattctgccctctgcattctgtgcaactgtataaaagtcaagttagtattacatgaattggggtagggttagtgcttgaaaaaatgttgaaccggctgggcgcggtggctcacgcctgtagtcccagcactttgggaggctgaggcaggtggatcacctgaggtcaggagttcaagaccagcctggccaacacggtgaaaccccatctctactaaaaatacaaaaattagccaggcagggtggcgtgtgcctgtaatcccagctactcggaaggctgaggcaggagaatcccttgaaccccggaggcgaaggttacagtgagccgagattatgccactgccctccagcctgagcgacagagcaaaaaaaaaaaagaaagtgcttcaagctgcaaccacggagctcgtcgtcagcagatggctgggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20672 - DNA, 3373 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20673 - DNA, 3886 bp, Homo sapiens
gtgcctaaagtggcatatgtgggtcacccttctagaggagctaactagagtcctaactaatgggatccagcagggccatttctccagagggccagtatcctattaggagactctggaattcttaggttctactcaagagtggaaggaccaatcacctctgatattctgtggaaggtttggggtcaaattctgccctctgcattctgtgcaactgtataaaagtcaagttagtattacatgaattggggtagggttagtgcttgaaaaaatgttgaaccggctgggcgcggtggctcacgcctgtagtcccagcactttgggaggctgaggcaggtggatcacctgaggtcaggagttcaagaccagcctggccaacacggtgaaaccccatctctactaaaaatacaaaaattagccaggcagggtggcgtgtgcctgtaatcccagctactcggaaggctgaggcaggagaatcccttgaaccccggaggcgaaggttacagtgagccgagattatgccactgccctccagcctgagcgacagagcaaaaaaaaaaaagaaagtgcttcaagctgcaaccacggagctcgtcgtcagcagatggctgggtgagcccctccagactccgaataggagatcaagagtttgattcattgcctgctttactggaattctacgcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20674 - DNA, 3037 bp, Homo sapiens
  misc_feature (19)..(20): n is a, c, g, or t
tgtggtaggggaaaaaggnnggttttttgtgtgatttgtaggtggagaaagaaaaagcttcaggggaacgagtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaaaaaa

SEQ ID NO: 20675 - DNA, 2731 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaacacacacacaaccgggacccaccacgcggacaccccaccccggctcgcgcaccccacgcgggacactcactaccggacctaacccaactccccctgcgacgacaacacctgccgcgccagaacacctccctgtgacacacgcgacccacacagggctacagaagcaaaggtacacagcgtacgttcaagacccatcaacatgcgaccagtcaaatagaggacgacgcccacaaataaagccagaacctactgcgcgtgcgtgatacacacactgacaccaccggcgccgaccatacgacaccgcccggcggcaaccggaacccattgagctc

SEQ ID NO: 20676 - DNA, 2401 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggccgggtgtggtggctcatgcctgtaatcccagcaccttgggaggcagaggcaggcaagaatcacttgaggtccagggagttccagacccagcctggtcaacactggcaaaactccattctctacctaagagaaacacaccaacag

SEQ ID NO: 20677 - DNA, 1174 bp, Homo sapiens
  misc_feature (3)..(4): n is a, c, g, or t
  misc_feature (6)..(6): n is a, c, g, or t
  misc_feature (9)..(9): n is a, c, g, or t
atnncnggngggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtacataacgtgcacaatgtagaaagaagagatctgctgcagggtctcctctcggtcctcttagagctttgtagcaatgctgactacagcattgggatgttgtagatggcaagccgctaagcactgatgttggcattgaatgttgggttttctcttcttcatagaaaacctgtttgggaatgagtaagcttaaaactgtataactgaatgttctattgatctactaaacacacttggactactttaa

SEQ ID NO: 20678 - DNA, 187 bp, Homo sapiens
gacgtacttaactaatattggtgccagtccagaatgtggtgcaatgagttcttcctgcacttggcctcatctttctgtattaccagttccatatctgcactgtccaggacagtggccactagccacatgtggccattgaacacttgaaatgtggttagtgagaatgggaaactaaacttttatatta

SEQ ID NO: 20679 - DNA, 243 bp, Homo sapiens
tgtgcagggaggcaagtgtgtggacatcctgggagcagagtccacggcactacagagctggggctgggaatggcctggactcaggacccagacagaaggccctttgctttcccagctcaggggaacagtgctgcctggaaccaggggtcagggctgacggcaaatatgagaggaaggctgaagtctcaggcagggtggccagaggcagcttctctgacacccaagcaagactcacaggctcct

SEQ ID NO: 20680 - DNA, 363 bp, Homo sapiens
tccaccagccttcagtagcagtgactcctgcactgacaccaccagtatgagtgggtaagttagtgatgggacagaaacacttctcaagatcttcaggcttggccaaggattatcagcccatgtgaatatggaatgaaagaaggcaaagagcggtatagtttgttctcttccttttctgcaagaagtctggaagtgtgttggctggttgtgtccctctgcaaacaaaggcagcgaggatccagctccttcccactgttctgtgcttctacccttagcatgtggtctttcttatcagtcagccctcattgtctcctggtagcaggtccagggatcacaagtaaatggtgacatctatagaaaaac

SEQ ID NO: 20681 - DNA, 258 bp, Homo sapiens
ccaaagtgctgggattataagcatgagccaccacacctggcctttatttgtgtttttattattgacttgtcagagttccgtatgtattcggtgtacaagtctttttttttcccagatgtatgatttgtaaatattttttcccatcattgggttttattttcacctccttaataccatctttttttccataaaagtttttgtttttagtatgtttttggttgctgctgctttttgtgtcacatgtaagaaaccattgtt

SEQ ID NO: 20682 - DNA, 616 bp, Homo sapiens
tacacgccatttctggttgggtcttttatccccagcctcagttgaacaggcttcagttcacatcgttttagccaaaactcatctatgcacggtcttttcagaacagattagggtagaattttgtggttttttttgtgacgaaaataaccttagtaattttgtttttgttttggtaactcaggacaactcacaccccctggttgtcttgattttttatttaaatgctgagtttaagtgcttgtgcagttggtttcttgaactgaacagcacactttatgtttattctattgcatgtcattgtctttttattctaagcaagaggtcagcaaattatgcccacaggccaaatctggctcaccctctgtttttgtaaataaagttttattggaacacagccacgtcccttactttgtgcattatttatgtctgcttttgcactacaagggcagagttgagtagttgcaacagagattggcccacaaaaccgaaaatatttactatctgaccctttacagaaaaagtttcctaatgtggttctaagttatcacttaagcctcttttggtcgtcaactttacccaatattttatccatgtacattaaacttatttactaacc

SEQ ID NO: 20683 - DNA, 420 bp, Homo sapiens
tgagccaccacgcccggcccggcattaaatattaattggtcttttaatgtatctcagctttgaatttaggatttgattaaccaaatttaactgtagtattttgtcttactatgactgcagaagtagacaactcttgccacatgtacattgtctgattttctctttatttgtatctggctatcatatctctcttggctactttggctctttttttttttttttcttttctatgccatacacacacagtagtagtggctgtttcttaacaggttgatttgaatttccaggtgcccctttagacatgaaatatgttctcagtactatactctaatttctgcttacttctttgtcacttttatctgctgcaacttaagaaatttgttttattttatttatttatttttttgagacggagtctcg

SEQ ID NO: 20684 - DNA, 819 bp, Homo sapiens
gatttgcatatcctagggctaatacttgccgttcattatcatgcatgtactatcattttttcaacatctggttagctcccttatgttacctttctgaatcctataggcaattatttacatttctgagccctagaattgggcagcacagactaaatatgcatctttccctacagaaaagactgttcaaataattgaagtccactgtgtctttggtcctctttttgtaaggtaataagtttcagttccttctagtgccatcactgctctgcacatccctttaattgtctaggcctcttttaaaacatagtactcagaattgaacacagtggtggagagttggaatcacagactcccattattcttttcaactctaaagttaccgttttttcttttttttctttttcttttcagagtccgataaaccttaaatgttgagtagatcgggtggatattttctgttttgtctgcacagtgtccttttcctcggggcatagcactctcctcttctctgggacctgctcctctccaggtcccactctgggaattgctaactgcttgttagcaattctctctccttagccacagagattcatcccagcatagacacctatcacaaacctaaacaatcagattttcttttctgtgatttttctaaccagagcttataattttggtttctaagatggtgaggatagaaatctgaagctggccgggcacggtggctcacatctgtaatcccagcgctttgggtggccaaggtgggtggattgcttgaggtcaggcattcaagacaagcctgaccaacatgatgaaacccag

SEQ ID NO: 20685 - DNA, 490 bp, Homo sapiens
aacaatatactgtataatttgtttgctttcctgatcctttctaagaaattatttacatggattttctctctccaaagaagatggtgacaactcacaaagatacctgcttttccccagaactatagctttgctgtaatgtactaacattgaggatttctggaagagagagagccatggcatgacagccttatcagagggtagcctcaagctaagatcttaaaaaataagtactgatttaaattatatttagaaggcaattcacacatccaccttagattttttaaaaattcattcattcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatatttta

SEQ ID NO: 20686 - DNA, 235 bp, Homo sapiens
ctgttttgttattaaatttttgatcatgtgattgaaattaatttatcattcttgtttgacaccctctataccatcccttgtctttttatatgttcatcatattttattgaattctgttttgagtgaaaatttataaaaatattttaaaattattgatggtgcattttccttcagagaagatttagtttcaatgctattttaattaattttgaaatatgccagttggaactatact

SEQ ID NO: 20687 - DNA, 380 bp, Homo sapiens
acaaaaccaggaaaaaggactgcttcccctccagctcttgattgggctccataagaactgccaaaaggccaggcagcatttgctactcttctggggttcacttctgaaaggtgcgaccctgcaacctagagcacagggaagttaggacagcaaaggagctgggctgagccgacgctggcttagaactctttctgatactccctgttcccgccagctcgttagcccagcctgccaatcagttttgcatcaataaactttatgttctgaggttggccagatgaatgagaggagagcagctaaagactgatctctgaccttggcacgtaaacagcctccagattggacttgacagttaataaaggaaaggccctgcaattctc

SEQ ID NO: 20688 - DNA, 328 bp, Homo sapiens
ggatgtgtaccaccatgcctggctaatttttaaaaaattttttgtagagacgagactccctgtgttgcccaggctggtctcaaactcctgggcttaagagatcctcctgcctcagcctctcaaagtgctggaattacaggcatgagtgtctgtatccagcctgtttttttcttatgcatgtaaacatatacataaatacatgtatgtatatttataaaattttattacactttatcttcttttatgctgaacagagtatccttagcatttcctgcatgccttttgctgattttgaatttgtgatgtagaccagcctggccagtatggt

SEQ ID NO: 20689 - DNA, 180 bp, Homo sapiens
atatcatttttaaggccacagagcagtaagaggggatgatagaattccaaagaggcagatttcatttgccattccaaaatcagcattgtcacaggacaaggacaccaccctctgttctcctcttcctgtcttcattccattccacacttttttcattaaactataatatttccatcacta

SEQ ID NO: 20690 - DNA, 471 bp, Homo sapiens
gcttttttctttcataaggaaagtactatgggaacaggttcaaaatgaatataagggagttatttatatattaggtaaagcacaaaaatgataattactgactgcacactcacagttaaagtcatttgggcagaaaatgttgacccgttggaacagaccataaacctgctgtaaagagccaagggaagtaaccaaagcgtattcagatagctgtgaagctggggagacacctgaaaaatctagcaatagcgtgaaaatcacttaagtaaaaaataaactttcagaggctgaagctatttgaatttaccaagatttagagatgaatgccaaagaggattagtaaaattcttccatgcaaaatacaacagtaatggctccatcacgacattgtaaacccaagcccgagagtcactatgtaagtgagagttgagtgcaatttgtaataagaataaaaacatttccttaaaaagc

SEQ ID NO: 20691 - DNA, 285 bp, Homo sapiens
ggtttgagcttgcccttcacttaaaagaggataggcagggttctggcagagaactttcccaacatcagtcctttttgacagtcccccttcactctcccatccaaaaacaggacttcagtggaaaatataactgaggttctggaagatgctctccatgagctacatatacacagaacagtagcaaattaacctggaaataacccccaaaagaccttagggaaagacatttattcttcagggtttatataaagcactgcttgggatgaaggaaaatgctgatattcc

SEQ ID NO: 20692 - DNA, 457 bp, Homo sapiens
gataaacttgtagagggatttggggagaggaagctttattgggatctctaggggctattttatattttccaatgtctgaactgtttttacaacagattttccacagaaagctcaacaagtcactaaactttctgagtctcagaatctgggacttaaaatcaggggaagagatgtgaatggctaaactttctagttgtgtgaatagtttgcaacatataaagaattggtcaaaatgtttattcttagggtcggtagttattctgacttcacagaagggaatatctggccaactttcctcacagaatatcaattgtggaatcaagtatagggaatatcatgcatttaaggttcacatatagccttaagttgatgtccatattgatttaactatcaaaaaggcaattagattagtggggtagccaagtcacccacaaagactgatgagctgatatagaaa

SEQ ID NO: 20693 - DNA, 466 bp, Homo sapiens
tataaaaactcttaaaactcagccgggcatggtggctcatgcctataatcccagctctttgggaggccgaggcaggcggatcacctgaggtcaggagtttgagaccagcctggccaacacggtgaaactctatctctctaaaaatacaaaaattaggcgggcgtagtggctcactcaagactgaggcagaagaaccacttgaacccaggagttggaggtttcagtgagcccagatggctccacggcactccatcctgtgcaacagagtggcacaggatggcaaaaacaaacaaaagctcttaaaactcaacaataaaagacaacccactttagaaatgagaaaagggccaagtgtggtggtaatcccagcactttgggaagttgaggtgtgtagattgcttgagcccaggagtttgagagcagcctgggcaacatggcaaaaccacatctctacaaaatacagaaa

SEQ ID NO: 20694 - DNA, 406 bp, Homo sapiens
aatggtgtgtcgacaggactagctatcctgcatattaattattattgaaaccattataggcagagcttttgcacaaatggtcgattcggttatctgttttgtggcttctatagttaacaattgcccagttgctccagggcaggtaggagacatgctggatcaatgaaccattgttgttaagtgcacttactattaccatgaaaattagaatggaggtgcttgaaaggcaggaatgaaaatgcccctgccttaccattatgcaaattacaaattctataaatgagataagtggggagagaaacacttttcataaatcttaactaggtaaaagagtttattaagtccattgtcaaaaacaaatgtttgttttcaatttgtcgacgcggccgcgaatttagtagtagta

SEQ ID NO: 20695 - DNA, 657 bp, Homo sapiens
gactgcagtccattgacgtacaacaagtctggttggggagggcagctttcccccatgaggtgtgccaggtaaaacctttgtaattacctatgaccaagcctgacaaatcacatgtaaggtttggccaggagctagattcctcagtctttactgagtcacaagtgcatgaatatgttcacaaaccatttcttaccatgttcgtcattgaaagttgagggcttgtgtatcagacaatgcaagaaacaagcagatggggaaactcattcataaacaatagcaagcatttatttattgcatataggtctgtgtgttggctgaaacagctcttactgctgcaggttttctggtccagctctgtttcaggctgcaagtcaagtccacttctgctccatgtgtctgattcttgaacacaatgcaacaagtgtaaacatgaagagcttcttttgcctatgtttggaactggcacactgtcacctccacccgtgatttctttggctaaagcaagtcttcttattaaatacagccaacaacaattcgtactgtcagtgttagtttctatggaggattggggtagtatttttaggcctttacccagagtctactaggccttgcattattcctttcagaaattattagcaacaggcatgacagccaaat

SEQ ID NO: 20696 - DNA, 242 bp, Homo sapiens
tcatgattctaagtatggagttaatattttctgtgactgtcactattactatgggtacataacaaattatcccaaaatgtggtggcttaaaacaatggcaatgttttttgttttgtttttgttttttttgctagcaaatctgcaatttgggcctggtagttatagttcatctctgttccaagaagtgtcagctcaaaggcctctgaagtcttacttggaggaaggcggcagatgttaataat

SEQ ID NO: 20697 - DNA, 355 bp, Homo sapiens
cctcccaaagtgctaggattacaggcgtgagtcaccatgcccggcccccatgctcttgccaacactaggtattatcaaatcttttaatctttgccaatttgataagtgaaaaaaatagcattttaatttgcatttcttaattacaaaagaggttaagtatttttttgatactttttactttttttcttggccattttctctgaaaaggataggcctattctttggctgcatttgtactgttttgcttttagtgatttgtaatcacattacttaaggaaactgggcttttgtcatgttttatacatatgctaatacagtttataattttttttctgtcaataaacactttaatgag

SEQ ID NO: 20698 - DNA, 461 bp, Homo sapiens
aaacaccagcacaatatatatagatatagagcatcgccatcccccgcccccctcccccgccaggttcccttacgtcctcttgtactgaactcctcgtcttaaccctcagaccctggcaaccatcaatctgttttgtgttcctagagttttgccttttccagaatgtcatataaatggaatcacacggtacgtagcatgtgcatttggcttccttcagagaaagacactcggactgcgattctctaaaggtgcaatgtacagtttcatgacctgggtagtagttacctggcttgatcaccttacaactgtttgtcagatggcgggcttctgagttctctccgtgtgtgtgtgtgtgcgtgtgtgtgtgtgtgtatcatgtttcaaacatataattttacatttaactgcctctaacttttatatgttggtgagggttattaaatgacaattattaatactta

SEQ ID NO: 20699 - DNA, 948 bp, Homo sapiens
aggaagagttattttacaaaacaagcttcattttgccaatttataaattgctttggagtttcatcgaaaggtctttaaaaaacacgttggccttggtgctggtgcatcacataaatcacagatgaaacaaacaagcctgtttcctactcaaggtgtgtctgtagagtcctgactgcgtgccaggggctctgtctggcacatttctgaactttgcaaaattaattgtgccgaagagaacaccatcaaacgcgtccggcatacagcgtaaacatcttcagaccgtgattctgcgccatcaaacgctctccagctaatttcatttggtgattactctgctagaaaaccgaggccaagtgaaactgcggaaatgggaacaatgtacggaggaaaaatctcaccccattaagagatccgtttcttctccgcacaaataagcccaccccgcctccgaggcaagactagatggctccaggatactctcggcgcgcccgctggccatctcgggcaggggagccccacacccggcaggaggaccaggacgcgagcggcggcgcctcggccctgggctgtttaggtaattcgcaaagtcccaacaatcatccccctctcccagaagctggttttcttgtgtgcagtggttacagaggcggcgaaaacacggttccccgctttcctctcctcaaggcactgtttgcagcggcagcagcggccgcattcggggaggcgcggtcctccccgcagagccgtcgcgcactcggcctttctcgaggatttgcctgggctcggccgcctcgctctcccctgcgcttccatgaccttctgagagcggcctcaccaccggaggctcggaggaagcaccaccctcggcgtccggggcccgtcgcgcggccgcgttcctccgactccttggagcacccgcgcgcgcgggcgcgcggccggggatcggcg

SEQ ID NO: 20700 - DNA, 382 bp, Homo sapiens
gataatcttttgttgagctctttcaaatgtaacatttcaaacttgctctcagaaactgttaggtatgcactgctgagaccttgaatttggagggtaataccagaacataagcttgccagcagaggaagacaatggtgtctcattattcatggaaacatactgttgctgtgctttggttcaagttttgatgaacagaaaatgtgctctgaacttattttcctttttgtgaaatcctgacacagcatttctgatttcaaaggaagctgtataaaaagaccaacagaaaccccacaaaatgagaccaccttaaaatcaagtttactgactaaatgggattaagctagagttgtgttcgaaaaacaataaacgagaaaaaaacaag

SEQ ID NO: 20701 - DNA, 767 bp, Homo sapiens
atagattatctgacagggtggtccggaatggtggaagtaaatcgacaggtgaggacactgaattagcattcagacagtggggacctcacaccttgtattcccttttttggtaagatttttattacctccttagaaagaggtaaattcatctatttcgagcccaaatttttctgtctagaagattggtagtcttatttttactaaagtacaagattatttagtaaaaggtagcattctctggctttttttttttttttttttaatgtttcagatctgtcacactaaaaagggctttagaccaggtgttgtggctcacacctgtaatcccagcactttgacaggtcaaggtgggaggattgctggaggccaggagtttgagaccagcctgagcaacatagtgagatctcagtctctactaaaaataaaaaaaattagccatgcctggtggcatgtgcctgtagtcccagctacttagtaggctgaggtgggaggattgcctgagcccagaagatagaaacagcagtgagccatgatcatgccactgcactctagcctgggtgacagagcaaaccttgtctcaaaaaataaagggtggggaagctttagcctaggcttttaattctcaattaccattataaatttattttaattattaactaattactttaattctcaattactatttttccatgaaaaggcttgatgttctaaacagtattataccaccaagttatctctactggaaaacccagatttcaagaaaaaaa

SEQ ID NO: 20702 - DNA, 487 bp, Homo sapiens
cagtcatcttgatttggaaaaatgaaaacaaagagctttacagagaattaaaggagaatttttatgaagaaattaaacctgctaaagaccttctaaatgccacccttgaggcattcaaaaagatttcaatttgtgaacttcaagattttttttgtcaggataggatgcgtatcaaagtgactgacaaaaaagaagttatgtgggcagggtgcggtggctcacacctgtaatcccagcactttgggaggctgaggcaggtggatcatctgaggtcaggagtttgagaccagcttggccaacatgatgaaaccccatctctattaaaaatacaaaaaattagccaggcgtggtggcgggcgcctataatcccagctacttgggaggctgaggcaggagaatcgcttgaatccaggatgcagaggttgcagtgagctgagattgcgccattgcactctagcctgggcaacaagagcgaaactccgttgca

SEQ ID NO: 20703 - DNA, 364 bp, Homo sapiens
ggtgtctctgtctggcacacagtaggtggtcaagaaggatttttaaaaatacatgaataaaaatcaggttatgagttctctaagttctttaaatttggccatgtaacccttacatcatagataaatttacacagttgatggcaacgaaatacatagagagcttcacattgaaacacaaaacggagccaggcatggtggctcactttgggaggctgaggtggacagatcacgaggtcaggagttcgagaccagcctggccaacatggagaaaccccatctctactaaaaatacaaaattagctgggcatagtagcgggtgcctgtaaccccagctactcaggaggctgaggcaggagaatcgttt

SEQ ID NO: 20704 - DNA, 1298 bp, Homo sapiens
ccaggttccaagaggagacacctggagacgcaggcaggaaccatgcagacctctgtgacctagccacggaagtcatatagtatcaccactgccatacctcttggtcaaagcagccctgagctcacccatgaagagggatatagacctccacttctagacgggagaagtacccaggaattttaggggccacctccagatagttgccaaacccctcccacccacacttcactgtcactttggagatggagtgaacgtgccaccttcctgcttgctgtctccataaaggctgtgcacaccctgcttgagaaagcttgggcgatgcgttttattttcaagtagaatgtggcaaagaccacttactttctctccagccacctccagatgcgcttgcaagctgtgcctgcccattcttccagactctcctgtccagtgtgactcactttgccaacaacggaggcccagagtgcttctgtctccctcccagctgcgcagggaaacagaacccagaccagcttctggatcagccctgtgcctgggatttctcactgaaacaaggtctcctggtgtcatttcctcccaatgctgtcctgggtgacactttccatttgagctgcttttttatataggccctagcaactaggggccgtgtcggaataacttcagacgagtcctttcactgttctttaaaaaaaaaaaaaaccactagaaaaccactagcccgtgaagcagagtgtttcatttcttgttactatacattgtctcccccacccacccgagtgatcagggagcgcagatgtgactcagctcacttcccaggagtctcttaaaaggttctgggcagaggctggtgaaactgccccagtcctcactgcctggatgagttcatggacaaacatgcatggcgtgtctgtccatctgcattagcgctgagcagaaaagatacggacgcacagcagctcatggtagcagtccacgcacgtcgtcctgcttgatgacaccgctaagaattaatccatttgggaggagagcaaccaaatccacccagggcggagtccaggacagcaggcaagggaagggaagtagagctgagctaccaggcttgggcaggtagcagcagcctggcagagcacactgtggtggggtggaagcctgcaccagttgtgcaggggctctgcccttgtgccctgcgtaggaagcagtgcagccagggaacagacacctatactttctagaactcttgacttggagctgttcaccccagtgcggaacgcagagaacccaccggaccaagagaccac

SEQ ID NO: 20705 - DNA, 512 bp, Homo sapiens
aaacacataaacatatgaacaagaaatgatgacggcaaaatgctccacagcaacctgaagctgggggtgtgacaggataatgagtggctctgttagatcagaagagtgagaaaagaactctcagagaggtggcatttgacctgtgagctgagtgacttggaggaggcattgtgcaaagatcagtgaaagagcattccaggcagagtgaacagttagtgcaaaggcccacaggcaggagcaatctgaagattgcaaagaactaggaaaaaaaaaaagaatttttaaaaattgccatgaggctggcacagagtggaccatccaggagtgagtggtacaaaattaggtccagggagttgcctatgactttatgatccaggagggagtttggattttattctaaatgtgataggaaaccacaggaggtttcagcaaaggaatgaatgggtctagtttatatttttactacatgcatcatcctggaagaatgtcacaaatataatacatggtgaaaa

SEQ ID NO: 20706 - DNA, 1132 bp, Homo sapiens
tggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagaccttccttttactaccgaaaatacatagttctgtcgaaagagaccttttgactggtccccagtgccctgactgtgtttaaatccctcactagtgaaatagggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggccagtgtggtgatcagtactggccacaccagtggccaaagagaactgcattcatcatgtggctgttctatagctgtgagctatggtgactgttatttttcctagtgatagttttcagtgacagcatagattctggtatcatatccaaggaataaacaaacactgtttttggctttttgtttttttgtttttgacataaaaataataagctatttttggcatatgcagacttttcacaaagtgattgttttcttgagctctggactacttggtaacattcataagttccttcactttgtagctccctctttccttccctccactccctgcaaaagagagcagaactgatttttcagaggtgatgtttacaacagttcaacacactcgaatgagcacttagaataatgtcaatagaggaagaaaaa

SEQ ID NO: 20707 - DNA, 400 bp, Homo sapiens
ttttcatcaacttcatgctgagtcctgtctcattttattatttacacaattgaaatataaaaaattgttcccaaatgatgccccccataccctaagtttagggggcagtagtgtaaagcagtgtccagacattggtcttagggctggagtggaaacagactcctagaggtgcacaagcacatggataattttacctgaatcaatttccaaatcctaaactttaaatgtctcttttttgaagcatttcttcctttgaaccagtgttcaagcggttcttccctttttattttttgatgtggagtttggctcttgtcacccaggttggaagcttgcagtgagccgagatcttgccactgccactgcactccagcctggacgacagagcgagactctgtctcca

SEQ ID NO: 20708 - DNA, 393 bp, Homo sapiens
ttttcatcaacttcatgctgagtcctgtctcattttattatttacacaattgaaatataaaaaattgttcccaaatgatgccccccataccctaagtttagggggcagtagtgtaaagcagtgtccagacattggtcttagggctggagtggaaacagactcctagaggtgcacaagcacatggataattttacctgaatcaatttccaaatcctaaactttaaatgtctcttttttgaagcatttcttcctttgaaccagtgttcaagcggttcttccctttttattttttgatgtggagtttggctcttgtcacccaggttggagttgcagtgagccaaaatcatgccactgcactccatcctgggtgacagagtgaaaactctgtcttag

SEQ ID NO: 20709 - DNA, 341 bp, Homo sapiens
ctacataagctcatgaaaataatgtcgttagtcattagaaatataaatcaaaggctgggcacggtggctcacgcctgtaatcctagcactttgggaggccgaggagggcagatcatgaggtcaggagatcgagaccatcctggctaacacagcgaaaccccgtctccactaaaaatacaaaaaattagccgggcgtggtggcaggttcctgtagtcccagctactcaagaggctgaagcaggagaatggcgtgaacccaggaggcagagcttgcagtgagccgagatcttgccactgccactgcactccagcctggacgacagagcgagactctgtctcca

SEQ ID NO: 20710 - DNA, 253 bp, Homo sapiens
gaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaac

SEQ ID NO: 20711 - DNA, 187 bp, Homo sapiens
ataatttgacaaacagactgcaaacaagcatgaaaagggaatagagcagtttttgcctttgattttaaggatcagtcctggtagaaggagctgatgcccaaaatattccatgcaatttcctaatacttgattcaaatcctttgacgaagaaatgtatcaaggtttgtataattgctgaaagaaattt

SEQ ID NO: 20712 - DNA, 2738 bp, Homo sapiens
  misc_feature (2084)..(2084): n is a, c, g, or t
  misc_feature (2182)..(2183): n is a, c, g, or t
caccaaaccacctgccggtgacatcgtctccttctgagatctgaggacatgaacacccaaccacctgccggtgacatcgtccccttctgagatctgaggacattgatacccagccacctgccggtgacatcgtctccttctgagatctgaggatatggacaccaaaccacctgccggtgacatcgtctccttctgagatctgaggacatgaacacccaaccacctgccggtgacatcgtccccttctgagatctgaggacatggatacccaaccacctgccggtgacatcgtctccttctgagatctgaggacatggacacccaacctgctgctggtgacatcgttcccttctgagatctgaggacatggacaccaaaccacctgccagtgacatcgtctccttctgagatctgaggacatggacaccaaacctgctgccggtgacatcgtccccttctgagatctgaggacatggacacccaaccacctgccggtgacatcgtctccttctgaggtctgaggacagacactcacatggacacctaaacacctgccgatgatattgtctccttctgaaatctgaggacatggacacccaaccagctgctggtgacatcatctccttctgagatctgaggacagacactcacatagacgcccaatcagctgctggtgacattgtctccttctgaaatctgagggttggaacacattggcctggctcagtgtttctccatgtggttttgagaccacctgagttggaaccgatatgggttcccagcctcacgcctggagagctggattttgcgagtgtgaggttaggtccagcatctgcatgtgtaacgagctcccaggtgtttcgtagatgcattagggcttgagaagctcctttctagcaccatcttcctttttgcgcatgagggagttcaggtccagagaaataaagcagcaaggttagtggcacagctggcgccccctgctttctaggaatttagaatattattgaagagagaggtattagaacctgtgaagtcaatacagagacctccaggcgagtggcatcctcactgaaaccactgacaagtatgctgaatagaaagtgtcatttctcctggaagaccctcagtgacccagctggagggtctctcctactcatcagctgtccctcactctgccatttcagcagctctgctcaccctgagcatgcagagagagcagcttttaaatgagttctaatccagaccagcttggctagcattgtctgtgtagaggtgtgctagtaagtctaacaactggctctctgagagagagtagccctacctaactggtagcatttgccacttcccatggtgtaaatactcccagcatggccaacttcaagcttactaagaggatttcgctgatcatggttttggggagagatgtgcagattgactcctgccagctagtaggagccggctccagcacaccacggcatctgtgtccaggaaccaggctgagatgtgggaaggccagagaaggaggaggctggcagatgcctgagggctgggaaggattgcatccaggaggacggccgtggtgggcatccctgcattggggggcagccgggcccaagatccagggggacagaaagcacaaatggtgctggggttcagtgccacactcaccctggggcagaggagggtgacactggccctgccacctgacctcagcctcaggggctccagatcctagccagaggccttgagtgcttcctgccacaaaggcagggggtggcctgggatttcctctctgatcggagctgatgtttccctccaggaaaccatccctgctcaccttgctaggcctggggcaagttggagtgaagggcaggtccctcagccttgcctttgagaccttaccttccacttcattcccgtctgtggctctcattccttccccacccctgccctatgctctggtgagaaggtgcaaccctgtgagcccccatagcaaggttcactccagccgtgctttctgcttgcttttggtttgtgaaaaccctccactttcttagaggccttctgcaaatgtcatttcttcntaaggatcttcctaccccgcccgagccagggagatccctcccttctctgagcctagagcaccatgtcccttccctgtagccctggtgacgtgcacccnnatggtggcccttccagtgacatggaggatgttttccctctacagacactgtctggttttaggatcccggagccaggcatctcgctcacccctgtagccaccacagcattcagccctgcagcctgggaccttgctaaggtcttgctttacccctaaaaaccaaaaatagtgtgtcacctttagcagtgattgccaacgcctctggagtgctggctgggacaggcatctctattttcatcctcaccaatcctgccagggagctactctggggagccccatcctgctgatgaatgaccgagtctcgcagcgatgacggaacctgcaggtcccaggcttgggcccaggtctgtctttctccaggggcctcacatccatctccttcccagctctccttttctgtaagacttcacagaacaggttcaaaatccatttgctggccgagcacagtggttcacgcctgtaatccagcactgtgggaggcctcgaggcaggtggatcacctgaggtcaggagttcgagaccagcctggccaacatggcgaaaccccatctctact

SEQ ID NO: 20713 - DNA, 3675 bp, Homo sapiens
agcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagctcaaggttttcagtgaaggcttgtcctggcacctctgggcattccttttcattactggttgagcatccttccttctgctctgtcaattggcaaaatatgctggagcacattctggactagcagttgccttggggtagtcaggctgggtatttgtttggtatctcttggtgtagcagaccccagaatctcatggcaattaggatttggtggctaaacgaaagagttagtgcaaggaaaagcctagttggaatttctgagtctgggccatccttaagctgctgtctactgcctgaatgggaagtaatgtcgaattggaaaattagctcaccatttttgttctagctttgcagacatttattcctctgatgataggctgagaaatgcctaggccggcttagaaggcacacagcatgacagaagtactccttcaaagcagctgtgtcaagaaggaagagctggaaaagtggatttgctggggaattagatgcatttagttttccacttacgcacaactgccttctccagtatatcataccaaggttttttaggcctttgtggcttaccctgcaggaacatactgtgtcctgttgttctggactgtagcatcttcaccaccatcctcttggcaatggttttttgtttggggttttttttttttttttttggacaaagtataataatattgagggacctttctagggagcctttggtcctttgtccccattttccaaagggagggaactttcctcttaaaagagacagtgggaacttttagccaggtttttggaaaaggcctgtgggctattaatgagagtgagctgcaaaaggaggaagggtttgtttgggtactttgaagtacttagctaggtgttttctacagtatcttatataattgcatcttacagcatctttacatgcgaaatagtttatcagttatcttcaattgcatattacaaaattctgattaaatttttcttaaataagaaaactatcatttcatatgacaagaaatcctaatttaatgttactccaaggttggttaattcagtggctcagtgataacaccaaagactcagtttcttgaaatttttttgctctgccatcctccatgtttatcctcacgccagttcgcctcatggtcccaatatggctactgtaattctgggaaggaaatgctgacagaaccgtgtctggcaaaagagagacagatttttctgtgtccttctaaagcaaggaagtcttcccctggaagctccagcagatacggcctcatggctttgctagaaatgggtcatctcactcctgtcattggcaaagcaagtaagatcatccatcaggagtggcttagattaatgaattatcctttgagtcgtgtagactagaaagttcagtcatgtctactagcaagaaaggagataagggctgttggataagcagcatctggtctcaaaggtacttcaacttttacagatgagaaacatgaatcagagtgactttcccaggctcacagcaagtaagagagggccttcagtgttagctgtgtctgtccctaaagcccatgttttatattgtatcttgctagagtataaagtaacttactttctaccttgtagaaactgatggtctaggagaagagatttgaactcaggtgcccagttgactctaatcttggcccatgtgagaggattgtactcagttgctctcctcatccagtgatgtttcttgtctaacacaagaagcctaggagtagaaagtcctaagcagagtagaataatagcggcagcagggagggaagtgtgaactgtgtgtccctgagcctgacttactgggcagggacatgacacttaaagcggcagctggccactctgtctttcctgcatgcactgagtatttggtagctcattagtgaccagtgatattgatcatcttttcatgtgctcacttactatccccatatctttgttgtttgcatcttttacccattgtatttgttgtttttgagacagtgtctcactctgtcacccaggctggagtgcagtctcatgatcgcggctcactgcagtttctgcctcctgggctcaagcaatcctcccacctcagcctcctgagtagctgggcttacaggcgcacaccaccatgcccagctaattaaaaaaaaaattttttttgtagcagttcggtctcattagtattgcccaggctggcctctcttagcttcaagctatcctcccgcctcggcctcccaaagtggctggaattacaggcataagccacaagccactgggcccagcctcttttacctgtttcaaaattgagttttattgagttgtaagagttctttattcattttaaacacaagtcctttgttggatatatcttttacatctatttttcccagtctgtggcttgccttttcattttgaagagcaaaagtttaaaattttgtgaatttattaaagctccgtttgttgcttttttctgttctagtttatacttttgtatcatattttaggaaattttgcactgggtatttgatggctcctgaggaggttcaactttcagagcgcactgatttctctgcacctgagattttgtactatttctgtatttctttcttctcagaacaaccagtgtcaccaggtatgagggcagagttttagcttgtttgctgagccccattcttgaagctcatttatttattcacctatctgtccatcaatccaacaaatatactgaatgctgctatgtgccaggtactggcactgttctaggtactggggcaatgacagttaagataatacccaatgaccctgctctgtacccttaagagcagactcagttgggaatgagttatccaaatatagggtgtacatgtagtcaggagagagcctcatacagctttgcctttggcagaatccttcaaacctctttgtcttcctacttcttgatattacaaatcatgagcctttcacatgcattgactctaaagaggtgggttcctggatagcagaagtagataggaaggcatcattgacatttactgagatggattgaatcagagggtgtaaattctgctccatcaatgttgaaaaagactagcccaccccaaaggtttatcactgtcaccatgtctaatgtctattctggaagaagctgaagaagtctgcctttgtttagggaaccggttccagaatcagaggggttgaggatataaaagacccttgcacaagagttggtatttaccctgtcagatgctgctaccaagatttggattgtgtacagtcgaggattaaaaatgacttttaagat

SEQ ID NO: 20714 - DNA, 3949 bp, Homo sapiens
agcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagctcaaggttttcagtgaaggcttgtcctggcacctctgggcattccttttcattactggttgagcatccttccttctgctctgtcaattggcaaaatatgctggagcacattctggactagcagttgccttggggtagtcaggctgggtatttgtttggtatctcttggtgtagcagaccccagaatctcatggcaattaggatttggtggctaaacgaaagagttagtgcaaggaaaagcctagttggaatttctgagtctgggccatccttaagctgctgtctactgcctgaatgggaagtaatgtcgaattggaaaattagctcaccatttttgttctagctttgcagacatttattcctctgatgataggctgagaaatgcctaggccggcttagaaggcacacagcatgacagaagtactccttcaaagcagctgtgtcaagaaggaagagctggaaaagtggatttgctggggaattagatgcatttagttttccacttacgcacaactgccttctccagtatatcataccaaggttttttaggcctttgtggcttaccctgcaggaacatactgtgtcctgttgttctggactgtagcatcttcaccaccatcctcttggcaatggttttttgtttggggttttttttttttttttttggacaaagtataataatattgagggacctttctagggagcctttggtcctttgtccccattttccaaagggagggaactttcctcttaaaagagacagtgggaacttttagccaggtttttggaaaaggcctgtgggctattaatgagagtgagctgcaaaaggaggaagggtttgtttgggtactttgaagtacttagctaggtgttttctacagtatcttatataattgcatcttacagcatctttacatgcgaaatagtttatcagttatcttcaattgcatattacaaaattctgattaaatttttcttaaataagaaaactatcatttcatatgacaagaaatcctaatttaatgttactccaaggttggttaattcagtggctcagtgataacaccaaagactcagtttcttgaaatttttttgctctgccatcctccatgtttatcctcacgccagttcgcctcatggtcccaatatggctactgtaattctgggaaggaaatgctgacagaaccgtgtctggcaaaagagagacagatttttctgtgtccttctaaagcaaggaagtcttcccctggaagctccagcagatacggcctcatggctttgctagaaatgggtcatctcactcctgtcattggcaaagcaagtaagatcatccatcaggagtggcttagattaatgaattatcctttgagtcgtgtagactagaaagttcagtcatgtctactagcaagaaaggagataagggctgttggataagcagcatctggtctcaaaggtacttcaacttttacagatgagaaacatgaatcagagtgactttcccaggctcacagcaagtaagagagggccttcagtgttagctgtgtctgtccctaaagcccatgttttatattgtatcttgctagagtataaagtaacttactttctaccttgtagaaactgatggtctaggagaagagatttgaactcaggtgcccagttgactctaatcttggcccatgtgagaggattgtactcagttgctctcctcatccagtgatgtttcttgtctaacacaagaagcctaggagtagaaagtcctaagcagagtagaataatagcggcagcagggagggaagtgtgaactgtgtgtccctgagcctgacttactgggcagggacatgacacttaaagcggcagctggccactctgtctttcctgcatgcactgagtatttggtagctcattagtgaccagtgatattgatcatcttttcatgtgctcacttactatccccatatctttgttgtttgcatcttttacccattgtatttgttgtttttgagacagtgtctcactctgtcacccaggctggagtgcagtctcatgatcgcggctcactgcagtttctgcctcctgggctcaagcaatcctcccacctcagcctcctgagtagctgggcttacaggcgcacaccaccatgcccagctaattaaaaaaaaaattttttttgtagcagttcggtctcattagtattgcccaggctggcctctcttagcttcaagctatcctcccgcctcggcctcccaaagtggctggaattacaggcataagccacaagccactgggcccagcctcttttacctgtttcaaaattgagttttattgagttgtaagagttctttattcattttaaacacaagtcctttgttggatatatcttttacatctatttttcccagtctgtggcttgccttttcattttgaagagcaaaagtttaaaattttgtgaatttattaaagctccgtttgttgcttttttctgttctagtttatacttttgtatcatattttaggaaattttgcactgggtatttgatggctcctgaggaggttcaactttcagagcgcactgatttctctgcacctgagattttgtactatttctgtatttctttcttctcagaacaaccagtgtcaccaggtatgagggcagagttttagcttgtttgctgagccccattcttgaagctcatttatttattcacctatctgtccatcaatccaacaaatatactgaatgctgctatgtgccaggtactggcactgttctaggtactggggcaatgacagttaagataatacccaatgaccctgctctgtacccttaagagcagactcagttgggaatgagttatccaaatatagggtgtacatgtagtcaggagagagcctcatacagctttgcctttggcagaatccttcaaacctctttgtcttcctacttcttgatattacaaatcatgagcctttcacatgcattgactctaaagaggtgggttcctggatagcagaagtagataggaaggcatcattgacatttactgagatggattgaatcagagggtgtaaattctgctccatcaatgttgaaaaagactagcccaccccaaaggtttatcactgtcaccatgtctaatgtctattctggaagaagctgaagaagtctgcctttgtttagggaaccggttccagaatcagaggggttgaggatataaaagacccttgcacaagagttggtatttaccctgtcagatgctgctaccaagatttggattgtgtacagtcgaggattaaaaatgacttttaagatgcagtgtttcatctggtgacatttaatttgatattttaaaattggggagggtattttcagccatgggggtagggatgtgaaagaagaagaaagtaagaattggagtcagatgtggttttgagtcccatacatttattgtttaatattatatggtaagtactttaaaatggtaaatagtaaatacttgtgttattcactaacatttggggaggattttctctgtgctttatgtatattacctaaccttacaaactgtgtaaggtacatgctgttc

SEQ ID NO: 20715 - DNA, 318 bp, Homo sapiens
tttttttccctgccacatgtgactcacctcccctccctcaaacctaacctgcccctcaggggccttctgcccgctttggggtacccatagcgggaccgagacgctccctgggttcgaaccagggtccggggccatgtgcaggggctgatgggaaggcactttcgtccgtgggagacccacgaacgcttctcggcggcgcggttgttttttttttttttttcctgacacaggtgcttcacctcccctccctcaaatcttaccttcacctcaggggccatctgcccactttggggtacccctagcgggcccgagaagctc

SEQ ID NO: 20716 - DNA, 397 bp, Homo sapiens
tactaaaaatacaaaaggcaataagaggttctatgtggactttgaaggtcgtctctatcaatttgaggttggaaagaacagttttgttgacatcctttagctgtgttacaagtacaattttgttttttactcaggcaaaagaaaatgtgtgtgtgtgttaaatacagtcagccctctttatctgtgggtcctgcatccttgctttctaccaacctcagatcaaaaatattccagaaaaaaaaggatggttgcatctgtactgaatatgtacaagctttttttcttgtcattctttatgcaataaagtataacaaccatttacgttgcatttccattgtattaggtattgtgggtaatctagagatgatttgaaggatattggagggtgtgtccaggc

SEQ ID NO: 20717 - DNA, 5828 bp, Homo sapiens
ctgcaggccgcccgcgtctgccctcgcggcgcgctcccgggcccggccgcggttccccactcgggccggctggctcgcgggttctctcgccccgcccccctcggcgccaccgctgggcgcttgcgcggggcgcgtggccgtggccagggtctccgccgcagcccgagcagccgccgccgcctcagtcagtcagtcagtccccagcaatggcggacggaggtgagcgagaggagctgctctcgccgtcaccggtctctccggctaagcggcagtgttcgtggcccagcccgcaggctcatcaccctcgcggttcgcctggggcagccggcggaggggcagggggcgtcggcagcagctgcctggtcctcggggcccgcccccacctgcagccggattccttactggactgcgccgccaagacggtggcggaaaagtgggcatacgaacgggtggaggagcgcttcgagcggatcccggagcccgtgcagcgccgcatcgtctactggtccttcccgcggaatgagcgggagatctgcatgtactccagcttccagtaccggggcggccccggcgccggcgctgctggcggcgccgcgggggcttcgccggccgaggaggggccgcagccaccccccggggccgccgctccggccggctccgcccccgggggcgtcgcggctggggcatcccccgggctgggcgcaggggccggcgcggccggctgcggtggcgaggggctcccgttccgccggggcatccgtctgctggacagcggctccgtggagaacgtgctgcaagtcggctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaagcagaaattgtg

SEQ ID NO: 20718 - DNA, 6491 bp, Homo sapiens
cagttaattcagaaactttattttgccaaggttgaagatgcgtgcccgtgacacagcctcagggagtcctggcgacatgtgcccaaggtggtcagggcacagtttgttttcatacattttaaggagacatgagacatcaatcgatatatgtaagaagtacgttggttccgtccagaaaggcggggacaactcgaagtggggagggggcttccaggtcgcaggtagctgagagacaaatggttgcattattttgtttctgacaagcctctccaaaggaggcaatcaggtatgtgtctatctcagcgagcagaggatgctgctgaaccctggggtcgctggggccttaaatgactttgatgatgagagactgggcatggagagctagaggccctcatctcccttccccagcgagtcggaagcgtccccattactagttcctagaatatgctgagatgtctcaggttgcggtgtgcagctgggagttgcagcctggcaggaggcccaggttttagcctgtgaaccggggccctgctatgtaggccagggtggctctgacctggcactctgtggggccagggcagacatagcagcaaaggccatggggtcacaaagagagagactgcagaaggatcaggagtaacaggcataatggggctattcttccctaggcctgaacactgggaaggcactggcagggccccggttttgatggtggattcttggagtaggggccttggtaatagggctctgagtgctggggcagaatgggctatcttgacccttcatagtcagggtcccaagtgggcaatcctggagcctccaggtctttggtccagcggcggggttttccactcaagggccacaggtacagacaagcagagcagaaacagcccccccggcctttcacttcccacctgctcccgagggagagagtaaggtttctgggggtaagtgggggctatctgaaagaaaagggtgattttggctggggctcggtgccctacaagagcccttgcttgactttgacgcaaggcacagactgggctctgaaggggcaggctggggggtagacgtcgtcatggatgttggatctcccttccggccatggcccaagtacgacccctgttcccttaaagtcaggacctcgcagaactttcgcaagatgggtcctcggagtctgcccgcgattgcgctcccaaggggtgccgctgccgagggtaggcgcgccagtcgagatcaaagcggatgggatgacgccactggagggcgcgcggggccgcggggcagggtggtgctcctgctgcaggtttcaggcctcttctgccttctacagccgccaggtcagcagaggcggaggcccgggctgtggatggccgaggagccgaactcgtgaagccacgttcctcctgcagctcttaacccaggcgcggcggctcgccgggccgctccccttactccgaaaccgctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaagcagaaattgtg

SEQ ID NO: 20719 - DNA, 5254 bp, Homo sapiens
ctgaacaagaattaggatccttaaacaacaacttcagactggaacaaagcaacaacaacaaaaaaaccaacaatatgatcactgagcgctctaatgccgccaggtcagcagaggcggaggcccgggctgtggatggccgaggagccgaactcgtgaagccacgttcctcctgcagctcttaacccaggcgcggcggctcgccgggccgctccccttactccgaaaccgctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaagcagaaattgtg

SEQ ID NO: 20720 - DNA, 4462 bp, Homo sapiens
  misc_feature (4427)..(4428): n is a, c, g, or t
cagttaattcagaaactttattttgccaaggttgaagatgcgtgcccgtgacacagcctcagggagtcctggcgacatgtgcccaaggtggtcagggcacagtttgttttcatacattttaaggagacatgagacatcaatcgatatatgtaagaagtacgttggttccgtccagaaaggcggggacaactcgaagtggggagggggcttccaggtcgcaggtagctgagagacaaatggttgcattattttgtttctgacaagcctctccaaaggaggcaatcaggtatgtgtctatctcagcgagcagaggatgctgctgaaccctggggtcgctggggccttaaatgactttgatgatgagagactgggcatggagagctagaggccctcatctcccttccccagcgagtcggaagcgtccccattactagttcctagaatatgctgagatgtctcaggttgcggtgtgcagctgggagttgcagcctggcaggaggcccaggttttagcctgtgaaccggggccctgctatgtaggccagggtggctctgacctggcactctgtggggccagggcagacatagcagcaaaggccatggggtcacaaagagagagactgcagaaggatcaggagtaacaggcataatggggctattcttccctaggcctgaacactgggaaggcactggcagggccccggttttgatggtggattcttggagtaggggccttggtaatagggctctgagtgctggggcagaatgggctatcttgacccttcatagtcagggtcccaagtgggcaatcctggagcctccaggtctttggtccagcggcggggttttccactcaagggccacaggtacagacaagcagagcagaaacagcccccccggcctttcacttcccacctgctcccgagggagagagtaaggtttctgggggtaagtgggggctatctgaaagaaaagggtgattttggctggggctcggtgccctacaagagcccttgcttgactttgacgcaaggcacagactgggctctgaaggggcaggctggggggtagacgtcgtcatggatgttggatctcccttccggccatggcccaagtacgacccctgttcccttaaagtcaggacctcgcagaactttcgcaagatgggtcctcggagtctgcccgcgattgcgctcccaaggggtgccgctgccgagggtaggcgcgccagtcgagatcaaagcggatgggatgacgccactggagggcgcgcggggccgcggggcagggtggtgctcctgctgcaggtttcaggcctcttctgccttctacagccgccaggtcagcagaggcggaggcccgggctgtggatggccgaggagccgaactcgtgaagccacgttcctcctgcagctcttaacccaggcgcggcggctcgccgggccgctccccttactccgaaaccgctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcagatagcctgnnagattgtccaccgtgagagatctgtgacactggg

SEQ ID NO: 20721 - DNA, 401 bp, Homo sapiens
gctgaggctgcaaggtagctctttcaagatatcacctgtgatttattcaactttttatatccttaaagataaagacacagttcctggtatacagtaggtgtcaggttgaatttgaggaactggactgaatacaaactctctttgtcaggtataaattttcctgacttgaaattttaactagaccaaaatatcttcttcttacttggtagagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaaggtatagtaattaggagccatctaacccccttaggcccaaagctga

SEQ ID NO: 20722 - DNA, 494 bp, Homo sapiens
ctcacacgcgggccacattcttgtgtgtcggtgtgacggtatgtttagttaacgactccagaacttactgtttcctgggtaggcctcttgtgcaccagaactgctggctgtattttgcaggtattagtatgcctagacggtggagttaccaaagttgttcttttgtgccaggcctcgaaatgcagtgcgatggtttggccagttccgctcaaccgatgtttagacttatgccgagaatttggattctctgtgaccatttttggttaggagttagaactgtttaccatactgtttggattggagggcatagttgagcagattaacacttttaaaaaaccagaacttaagctggccttttgcatgtcactggtacacgatacggtagtagtatgacaggcagcagttcggtaaaaagtttaccttacctaccactaatactgtataatgttgaacagttaccatatgatgctgtgatttgattggaaggcagtttg

SEQ ID NO: 20723 - DNA, 418 bp, Homo sapiens
ccattaggtattcattacatagacattaagctttttctgtgtgtctgtgggtgtgagagagggagacagaaaagaaagggagtgataatgtatatgtctccagagatcactgtgttgtttacttttactgttaaagatctagggccaggtgcggtgacttacacctgtaatcccagcactttgggaggctgagagcaggtggattgcttgagcccaggagttcgagaccagcctgggcaacatggcgaaatgctgtctctacaaaaaatacaaaaattagctgggtgtggacccagctactcaggaggctgaggtgggaagatcgcttgggcccggggggtcgaggctgcagtgagctatgattttgccactgcactacagtctaggtgacagagaccctgtatcaattaaaaaaaaa

SEQ ID NO: 20724 - DNA, 789 bp, Homo sapiens
ctttttttttcagttctgtatcaatgaatattttcttctgaaaaactcaactttaaactttgtaattttacagttccattgagattatattgtttatttgttttaagacatatactataactgttttggttttgcttctagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcaggtacaaacagtattttttatattataaaaagattttatatatatatatatatatttttttttttttttttctttgagacagagtctcactctgtagcccaggctggaatgcagtggcgcaatcttggctcactgccagctccacctccagggttcacaccattcttctgcctcagcctcctgaatggctgggactacaggcgcccgccaccacacctggctaatttttttgtattgttggtggagacggggtttcacgatgttggccaggatggtcttgatctcctgacctcgtgatccaccccctcagcctcccaaagtgctgagattacaggcgtgagccactgcacccggctgaaaaagattagatttgcaaaggggcatgtggaatttttttttgaaagtcatgtagaatagtttataagccagccctttcagagagaaaaaccaccacacaaaactttcttttctagtaaattac

SEQ ID NO: 20725 - DNA, 2462 bp, Homo sapiens
  misc_feature (67)..(67): n is a, c, g, or t
  misc_feature (70)..(70): n is a, c, g, or t
ggcggcacggcggcggcggctacagcagctccgccggcagccgcgggagcacggcgacgccagcggnggnaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttataggattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttcta

SEQ ID NO: 20726 - DNA, 2205 bp, Homo sapiens
ctttttttttcagttctgtatcaatgaatattttcttctgaaaaactcaactttaaactttgtaattttacagttccattgagattatattgtttatttgttttaagacatatactataactgttttggttttgcttctagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttataggattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttcta

SEQ ID NO: 20727 - DNA, 1983 bp, Homo sapiens
gttcggggttggatattggaccctgggacagagcagccagttgttcatgtactgcccgaagctgttcctgtagttctgctaagcgatgagtaagggaaaggaagcctcctagggtgtagaataggaagtatgtgcctgcgttcaggcgttctggctggttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttataggattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttcta

SEQ ID NO: 20728 - DNA, 428 bp, Homo sapiens
tactgttttctaatgatgtatgctcaagaaaagggcatatattacattcaggtaagtgtagtttttcctttgtttttcatgcttgtaaagaaaaagtgttatcaagggtatgttttcattaaaacaggaagttttgaaagtgcaaaccctctgagatctgacaaatcataactatctcagagcagaggggtctccatggtaactgagcatgtgggctctgatgtttctccactgagtagggaagccagccctccacttagcgggggacctgcaactcacttatctttttcctctttttctcccattcccccatcttctcttccctcttccctctctccactgtcaagaagaactaagatgtcattatttggcagattttaaagaggaattttcttacaatttttctttagtggtcttacaatgaacta

SEQ ID NO: 20729 - DNA, 294 bp, Homo sapiens
agccgaagcaactttgtttaattttgataatacaagtggggaaattgtttatgatgatttatagttgaaagcgcaagcctcagtgtatgtcgtgggcaagatttcatgaatgtaagccattttggtgcttggtttcttcattgcagctattgactgggaatatcttttcaggtaaaatgtttcaagcgccggatcttactctgattgtagaattcatattcatgttttacaaggagaaacccattgattggctcctggaccatattctctgggtgaaagtctgcaaccctgaaa

SEQ ID NO: 20730 - DNA, 5502 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcggaggcagggcccagccctgaaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20731 - DNA, 5330 bp, Homo sapiens
  misc_feature (126)..(126): n is a, c, g, or t
gttaaaagtagcagggcccagatatgccttgggactccagtgtgagcctcgtccttgtttccagctggaaggaaggcaccctcttgcccaagacaggacactgtgctgcctggggccagcacctgntgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaaggtgagcccgcgtttgggggtgctccgggctcaaggcttggggtcaggtcactttgggggcctgcagtttagggagccgggctgcccttatgccactgagaagaaagcaggagcagagggaaggagcacctcatcagtgagcagttagtcatccggaaatgattttccctgggaaggacaagagatacaaaccaacatggacagttatgaagaacaggctcagaagagttaggatcagttggggaagagaccagtacaatctacattcctaaagaaagttcaggaatatcccctgggaatgtgcacgggcaggaaaaggagcctgagcggtgggtttgtgcctggcttggcctcatcctcgctcacctctgagtctccgcctcttctatggtaacggggataatctcactccctgttgccataaggacattgcacttactaaacagccatgggcagtgcattgttccctgcaaagtgctggtcagcgatcatttgaccactgcttcttcccatgccgcttccagatgaatctgaggcctccaggccagactcgatccctctatcccacagcactgggtgctgactccacacatccccctggcttaccgctgggtctggcctccccatttctcccccaggggtaccccacttgctgccaaccatccacccctgacccccatctcacctgtcccctccaagttctgggctggcattttcctttttctggcaaacaagtagacaaaacccccataaaaaccaaaagcccaactccatctcacagccaaaggttttgggacctttttcttcccccctccctttctctctctcttgctttcgttttcttttgttaggtttattttatttattccaagtaaactcccagaacagctgatgatgtcagacaaatcagggacatttgctctttttacctccacctcaaaaactgatgacaaggggagaagaaagagccaggggggagagtgaggcaggggagtagaacctgcccaggcacatggctgcaaattccccgtgtgctgtttggcttctggggtcctgtgtagacgccccagccccgcctgccctcttgggatgcagctgccctgggatgagcagacagccctcggcccgatggagcacgacttatttattacggtccacacagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcggaggcagggcccagccctgaaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatgg

SEQ ID NO: 20732 - DNA, 423 bp, Homo sapiens
  misc_feature (31)..(31): n is a, c, g, or t
gcctactactactacctactactactaaatncgcggccgcgtcgacagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaagtcgacgcggccgcgaatttagtagtagtagg

SEQ ID NO: 20733 - DNA, 5054 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20734 - DNA, 4357 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcggaggcagggcccagccctgaaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatgg

SEQ ID NO: 20735 - DNA, 4519 bp, Homo sapiens
ttgaacgtgacgaacacagctggcacatccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20736 - DNA, 4242 bp, Homo sapiens
atacctaccgtctggaaactaggctttctgcgaggctgcggagcctggcgatttagggactcacggcgtgtgttcacttgtggaagggcagagcgaagcctacctattggagttccatttattggcatcaccctcctcagagaagagagacggggtttcaccgtgttagccaggatggtcttgatctcctgacctcatgatcagcccacctcggcctcccaaagtgctgggactacaggtgtgagccaccacgcccggaatgaagtatttcaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20737 - DNA, 4949 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20738 - DNA, 4964 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20739 - DNA, 4866 bp, Homo sapiens
  misc_feature (126)..(126): n is a, c, g, or t
gttaaaagtagcagggcccagatatgccttgggactccagtgtgagcctcgtccttgtttccagctggaaggaaggcaccctcttgcccaagacaggacactgtgctgcctggggccagcacctgntgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20740 - DNA, 3881 bp, Homo sapiens
cggcaggagggcactttataatgtgtttgagcaaacctcgcacccaggtggttcagctcgcatagtggtttcaagtgccccatttgctccaagtctgtggcttctgacgagatgctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20741 - DNA, 3442 bp, Homo sapiens
gtcgcaccggttgtgctggtcccaggtctggtgaggagtgtaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctttctgggatgggagagaaggtgagggagccggcgagccggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagttggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttc

SEQ ID NO: 20742 - DNA, 1699 bp, Homo sapiens
ctgccgccctccattgtctccacggcggcgaggagcgccggcgagcgcagcccgggaccgagcggggcggcgcggctggcggggccggcggcggctgaagcgagagcgcggacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaattttacaacaaaaaaagaaaaacaaaacaccccgggataagcaaag

SEQ ID NO: 20743 - DNA, 835 bp, Homo sapiens
attctagtattcataaaattgctgaggttttattttataatttctattcacgtattaattaacaactccctgttgctgtttgaaggctcattagccattttaaaataagtcccaccgcagcttgcaccatggcagagtttacatgaaacttagagtcagtatgatgccaaagtctactgagtctgagttcttacctgtttcacctcaaagtgattttgagtatacctcatagcctgtgtctcaacttagagtatctgaatcattacctgttggtttactgacacttaaagcctgtggtacttgaggagtagagtaataggcaaagagaaatttaattttactatgtagataaagaatggggcaagctgtagtaattcctttatttttaatcgaggatttaagttatataagtacacattaagattctgtttttattgctcttaaaatgattattataaatactcattaatatcgttgctttagagtgccaaaggaattcttaattttagcggtaaaaagaaaatcatgttatgaacatttaaaatattcatacctgtaggtttctattggaagtaaaaaataaaatattcatacctggattttttactcagatacactaatgaattggaacattctggaatgggcatgggcatttttacatgcctagttttaaaaaccattcctgattaagaactattgccttaaagaaaatcaggccgggcatggtgtctcatgcctgtaattctagcattttaagaggccaaggcgggcggatcacctgaggtgaggagttcaagaccagcctggccaacacggtgaaaccccgtccctacta

SEQ ID NO: 20744 - DNA, 348 bp, Homo sapiens
acttttataattataatatgttctcttattcatcattttggcaagatggaaaggtttatattgttctgctttgcctctttgctatctctttttaagatatttgagaaaatgaaataatgggaactataaataactctctgacagtcttgctggtttgatgtgactttctatctcagctaccacataaaagatatttattgatggtaaaagaaatgtttctgaaactttttgttcataaaatgatatataacaaaattacattataatatgtgtactgttacaaggagtatgttttgctttgcaggggtataatttagactgctttttattgtgtatagggggaggttg

SEQ ID NO: 20745 - DNA, 322 bp, Homo sapiens
attagggttcaaaaatagacttaaaaatttgagaaaataatgcatagaattaaggttcataagtggatagttaatttttttaaaaaaattcaccaatatcttgcttatttatttacacattggtctcctttatagtcccaataattaagtattatatagtagctctatataatacttaatttctgattgtctatttcataaacaatttgactcaaatgatttaagggagaaatttctacaggatatttaagtaggagtcaatatttaacatttgcctatttttttatatcagattgtgttgtcttttggcacaaagttgtag

SEQ ID NO: 20746 - DNA, 159 bp, Homo sapiens
tcttcgcggattagctggagtgccagctcctttgtaaagtgcgtcttgcttgggaacgtactcctcctttgcccggcacgtcacagatatgaaattaatgttggctttgcttagggccctctgctgtgactgtgcaggtctcttccagggcctcctcag

SEQ ID NO: 20747 - DNA, 393 bp, Homo sapiens
gtcacactgggggttaggacttcaacatacagattttgaggggcatgcaatttagtccatattatggaataaggaaagttctttttagaatattaaatacagacctgtaggtatgttacattgtggaggttgagtatgatatagtggtcttccttatcttctggatagataacttaagcccctcactactggcagcaaatagtcaatgctactcctttctcttggccagtctactctcctacctttttttttttttaaacatttgttttggaggctgaatgcattggctcatgcctataatctcagcactttgggggtccaggtgggaggattggttgagctcaaggagtttgagaccagcttgggcaacagagggagaccctgtctttacaa

SEQ ID NO: 20748 - DNA, 592 bp, Homo sapiens
agttgtccaatgcatcaatttattcaactaatgtttaaccagtacctacaggcaatctactctgctaattactggaaatgcaaagacagatacaatgtctctaaaatttggaatgtgtctgtgtaagaatttaaagcataaagaaatgcccctcaatataatgatataacttgttgaattaaaatagttcagctgtcagttattgaaaactagtaaaaagacttaactttcaccacaatctttagtaaaacttagaatgagacttacttctacttatagtcttggtttaaaaagcatagcacactacatcaagtaggccctaggcattcatatttgtttgcagaataaatatgctatggtccatttctcagcagtctaactctgtaaggcagttcttatattttaagtgtctaaaacacgtgtcttcttgatacaggaggaaatactgaattattcataacacagatgaaagtatttttcatctacttatatccacccttcttaaaaagcatgccttcaacccccatttgcatagctcctctgctaacttttagccattccctcttatgaatgtactgccctctttgtctga

SEQ ID NO: 20749 - DNA, 249 bp, Homo sapiens
gaaacatcagacttaagttgaactttagactaagtggaccttacagacatttatagaatattctactcaacaaactgcagaatatacattcttctcatcatcacatagaactacctatctcccagatagaccatatggtaggtcacaacaagtcccaacaaattttaaaaaatcaaaatcataccaagtatatctcctcagaccacagtggaataaaataagaaatcagtactaagaggaactttacaa

SEQ ID NO: 20750 - DNA, 284 bp, Homo sapiens
gctactatactaaattctcggccgtcgaccagagagctaagtgtaagagtcaaaactataaaacacttagaaataggagtaaatcagctgggcgtggtggctcacgcctcaacactttgggaggccaaggctagtggatcacttgaggtcaggagtttgagaccaccctggccatcaaggtgaaaccccatctctactaaaaatacaaaaattagctgggcatggtggtgcgcccctgtaatcccacctgctagggaggctgagggaggagaatgacttgaacc

SEQ ID NO: 20751 - DNA, 7276 bp, Homo sapiens
gaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggttggtcgatcactgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctaaaaaaaa

SEQ ID NO: 20752 - DNA, 331 bp, Homo sapiens
tgaagtgatctagaggatcccgttggtcgatcactgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatcgaaccaccgggatcctgcagatcgac

SEQ ID NO: 20753 - DNA, 1747 bp, Homo sapiens
atcatagcaaccaaacaatgaattgagacctggaggtcttgggttgtaatttaaattcacataaaccaggccttttgtgcctattgcctaattcatggcataattattattagccgccttaggataaaaggaatacagactttatcccatacatgaaattatcagactttcactcattttaatagctagaatcttattttctttccttaagatgtatattttcttttaatgaccaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatcttttttccccagtctcataaggaagagagaaaagtcagaaaataatatttaaattgtgtaactagcttattattttcatactaaaaagtaatcactgatagtttttctataggtatgagatcaagggaatcatttttagaaatcattttcattgtaaaaagtatattagatgtcttttgccaaattttatctagttagtaattataaacagtatcagtcttattttcctattgtttatgaacaatataaagacctcttaatagtgatctaaaagttttctattgtcactgggttaccttcagaatttctaggcctgttagatttatttttgtcgttagcatttaaagttttgctctgtattagaaaatagaaaacttagaaaaacaggtagtggcagttcatcacttcccccacttttatttccaagtcattatctagtttctcaatgtggcattgcaactctgattttttactgttcgtgcactaaagcatttgagataagcccttagtgttgaggaaatcctaaatcctactgctggggggttaaaagaaatatagtgacaggctatgaaatagtgttgtcataacttatcagtggctagtaaatagggtagttgccttctgacaccattttgagtgaaggcagtttaattgcgttgcctctgtttagataagcatttggaatccacagtcaaatgtgtgaatgctgtggttaaagtatttccattatatgagatttgatttcttaagtgatttttttgtctcaggttccattctacatcaaaaggtatttggaaaatgtctttcactgtatgtgtacacggagaaccttaacctataattgtatgtaaatctagtgattgtgaaaaacaagaaacttgcagacacatattaacagttggtgacttatcgccagttggtgacttacttacctacccctgcctctcaaatcttgttataacaattaaacagttcgtattaagactttgt

SEQ ID NO: 20754 - DNA, 6802 bp, Homo sapiens
gaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggttggtcgatcactgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatcgaaccaccgggatcctgcagatcgac

SEQ ID NO: 20755 - DNA, 6813 bp, Homo sapiens
gaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggttggtcgatcactgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatcgaccaacagtacagtgatcgaccgggatcctctagac

SEQ ID NO: 20756 - DNA, 5593 bp, Homo sapiens
gaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagagacccttgtgagcatacaagctctcatttggaagcctcgggaagccatatggttggagcaggtatgaattggaatcttgacagaacatcatcaaaactgcccacaacctcaattcagctcagtcccattggatcaggatcatcagcctcctctttgccagaagatggaaaggtatgaactgttctaacagcaagcgctagagcagtggtccagaaaatggtgggtaacaatgtgtctcactgtcactgttttggagattttgctgaacttggtgaacttgctctactctggcctggacagaaaagaaaagaaaagcttacacttcttggtttccttgttctgccttcctattgtgatgggaaaagacaacatagagtagaaattaacaaaggaatctctggagtgaggcattctgaaattttactgaagctctaaaacttaacagctatggaaatggtatatgatacatcagcaaaatgccgctgtgcaggaacagcatcccttgagtgattgtggtcttccttgtaacttcactacttattctactactgaaccaagcataattaaagatgaaaacaagtgaacagtattatg

SEQ ID NO: 20757 - DNA, 560 bp, Homo sapiens
cttctctcaagtgctacactctcttggatgggagataactttgtcccctggtgaaagcttgcattggttgctcaggcactgggaagctgtttttgtttggagtgtgcttatatgcgtcctgtaggaggacagctgaaaacctggtctccacctgctaatctggtgggcagacgccacagtgcagagaaacctggtatgcagaagatgaagacatagcacaacgtaagtcatgtcctatagatctatatcacctgtaaggcataatatcccagcatgtgcctctgaactcacattctgaaggtgcagcaaacatggatgggatctctagaggagtgggcacccggaatatatgcttcttgaccatgcaggcaagagtggaaaattgttagtatttagatttatgtatatggtaatatgatttaaacatgttttgttcacatatttctatctaatgaagttatcttcctgtcctaatgaggtgggtaacaatgtgtctcactgtcactgttttggagattttgctgaacttggtgaacttgctctactctggcctggacaga

SEQ ID NO: 20758 - DNA, 357 bp, Homo sapiens
cctactttcaaaagcaaagcatgtctagttcagtgtcagtggcctagtcaatgtttctttcacatggaagaaacccatacgctatcaatagtccaactgtcaagcttaagttggcccagtgctattatgtattgagagtggctacctaaagtgagactgattttgttgtaaaatttggtagaatttattggaatttagaaaatgtaattatactttcaaaatctttttttttgtttctttatagttttttatgtttttctccaaactaggattttaagagtggacttggtattaccataattcctatgaatgtagcaaatgtaaagcaagtggaccgaactgtgaaacaatcttttg

SEQ ID NO: 20759 - DNA, 305 bp, Homo sapiens
ctgcctagcagccatatttttcagctgttgtttaatttgtgagtgaaatgaatatgcaaactgaacatactgcttaattggcctttacaagggagatcgataacacagaaacgttaattgtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttg

SEQ ID NO: 20760 - DNA, 415 bp, Homo sapiens
cccatggcagatgccctgtggcgctcagtgcatgctgctctcccttctcctctctggtcgcccttggaatgagcctcttctgatcccaaagtgcagttggtagacttttcttcttctccgccagtttccactctgggggcctgagcatggcagagttctgatgtgggggcaggagcctgtgccctcccgtatctgctatgctgggggagggagaaatgacttccttccgtctttgcccttcgaatcatctctgatttttattttttaaaccagatatctcagtttttaacccatgctttaatttctcagatacctcaaaccctttggatggagggaaaatttgaaactgcaacgacatggatagaactatttgatgcagcagttttctaaagtatccataaaaactagtccgggg

SEQ ID NO: 20761 - DNA, 314 bp, Homo sapiens
  misc_feature (31)..(32): n is a, c, g, or t
cggaccaacttaggctgagctgctactcagnngcgagctgctaactcagggcgagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcctccctgggcagaaagtggccatgccaccctgttttcagctaaagcccaacctcctgacctgtcaccgtgagcagctcgcccctgagttaggca

SEQ ID NO: 20762 - DNA, 3343 bp, Homo sapiens
tgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggtccttgatactttatgagcctgtgcttagtgaaagcagatgggagatagcccaggcggggctgccatcctgggacttgcaggaaaactaagaagggtatggagggaatcgttgcctcccattcaggccctgaggtcccatttcctgggacagccgagactctcaggaggcagccctgaccgtcacccctccgccccgcctgtcctccaggaactgaagctgcccaccttccgagcccactccccactcctgaagagccgccggttcttcgtggacatcctgaccctgctgagcagccactgccagctctgccctgcagcccggcacctggcggtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctgaaaaaggaggggcagcctggcgtgttctcaggacccccggaggatcccatattgggtgcttttctttccctggctctatgcagaggggcctgagttggtgtgtatgcctgagtgtttgccttgcgaggcacagtgggtggctgtcttgcctttgttttcgaacctaaaaccattttcagccttttagatatgtcatgtgctgctgcttcccgaagtggtcttgctttctgtttcgtaagatgtcttgtttacacactgtatcagggatttggtgatacttgaaaattcctttggagaaaaaaacaaatttaattgccacactgcctgtcccacatgagggctgttaatttggaacccaagtttgaacccaacttgtgatggacccgcaggtaaccacagagcttcctttttgaaggcatatggttggagagaaccattttcccagctctcggttccggaagattccacgtcttggaggctgtgttcaccactagaactttaataactacccagggagggagaagctcgttgaaaggaagacaaagatttaaacagttcccacctctctccaccacatacttacagggcatgagtttaacccagtctaggctttgagtgtggctgatagcgaaggatagcaatgtggaaaatttgcttagtcccacctgtatttggggagtgggatgtacatgggcgtttgataccaccattgataggcaagcgactggttggatcaaaagccagtatttagggatctgcagcgagagggccctcaggaagactcttgtaaccatgtgcaatatgtttttattctgactcgcagcttgtgctcagcatgttctttggtttagtttggggttgggggacacattgttcacccagcagaactgggaggtgcaaaggaccgtggaagcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttgatctctca

SEQ ID NO: 20763 - DNA, 3550 bp, Homo sapiens
tgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggtccttgatactttatgagcctgtgcttagtgaaagcagatgggagatagcccaggcggggctgccatcctgggacttgcaggaaaactaagaagggtatggagggaatcgttgcctcccattcaggccctgaggtcccatttcctgggacagccgagactctcaggaggcagccctgaccgtcacccctccgccccgcctgtcctccaggaactgaagctgcccaccttccgagcccactccccactcctgaagagccgccggttcttcgtggacatcctgaccctgctgagcagccactgccagctctgccctgcagcccggcacctggcggtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtcccccttttcagatgaaaaatcctaggccccagcggtcaatttggttgatatcagctagctaaggagtgaccccgctggggatggagctggcccagaattgcctggaaagcagagattgggctcattcaggccccaggaacactccagtgccaggggatgggaaggcattggtgagcacaagcaggcgccatcctcctggaagccagagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctgaaaaaggaggggcagcctggcgtgttctcaggacccccggaggatcccatattgggtgcttttctttccctggctctatgcagaggggcctgagttggtgtgtatgcctgagtgtttgccttgcgaggcacagtgggtggctgtcttgcctttgttttcgaacctaaaaccattttcagccttttagatatgtcatgtgctgctgcttcccgaagtggtcttgctttctgtttcgtaagatgtcttgtttacacactgtatcagggatttggtgatacttgaaaattcctttggagaaaaaaacaaatttaattgccacactgcctgtcccacatgagggctgttaatttggaacccaagtttgaacccaacttgtgatggacccgcaggtaaccacagagcttcctttttgaaggcatatggttggagagaaccattttcccagctctcggttccggaagattccacgtcttggaggctgtgttcaccactagaactttaataactacccagggagggagaagctcgttgaaaggaagacaaagatttaaacagttcccacctctctccaccacatacttacagggcatgagtttaacccagtctaggctttgagtgtggctgatagcgaaggatagcaatgtggaaaatttgcttagtcccacctgtatttggggagtgggatgtacatgggcgtttgataccaccattgataggcaagcgactggttggatcaaaagccagtatttagggatctgcagcgagagggccctcaggaagactcttgtaaccatgtgcaatatgtttttattctgactcgcagcttgtgctcagcatgttctttggtttagtttggggttgggggacacattgttcacccagcagaactgggaggtgcaaaggaccgtggaagcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttgatctctca

SEQ ID NO: 20764 - DNA, 282 bp, Homo sapiens
attcgtgctggtgctggagtctgcgcgggacaaaatcatttacctacacgagaaggtgcatgagtgcctctggggatggggatggagaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttgatctctca

SEQ ID NO: 20765 - DNA, 411 bp, Homo sapiens
cagagccccagcctcgagcgagctagcggagttgacaactttctctgcaacttttgcaaaagggaagataaaaattctgcaagttgttgcacagctccatatcgccccgtgtccggcgagcagaggggagggggcaccgcagccttccgcggaccagaggcgacctccagctcctctgagcggcgcaggagggggcgcccgccggggcccggggccaggggcgagagaggatagggacaccgggggtcggagcccggggtacgctctggccgctgaagttgcccgtgtccacgcagggtgcgccctgagagccgggtagcctcggatagcggcgctgcgtacgcgatgatggatgagccgtggtgggaagggcgcgtcgcctcggacgtccactgcaccctgcgcgagaag

SEQ ID NO: 20766 - DNA, 473 bp, Homo sapiens
gtttaagggagcacttagcttgatcctccccctgcccacttcagtaaaccttcagtgcttgaagatcaggtattattaagttggtgcaaaaggaattgtggtttttgcctttgaaaataatgacagaaacctctgttacttttgcaccaaccaaataatctttataccagggcttgatcccactttgcttttggtatagaagtagaagaatgtctagaaaaatcactcagcaatcccagcactttgagaggccgagacaggtggatcacgaagtcaggagatcgagaccatcctggccaacatggtgaaaccccgtctctactaaaattgcacactcctgtagtcccagctactcaggagactgaggcagggaaatcgcttgaacccgggaggcggaggttgcagttggccgagattgcgtcgctgcactccagcctggcgacagagcaagactccgtctcaaaaaaaaaaaa

SEQ ID NO: 20767 - DNA, 248 bp, Homo sapiens
ggaggaatgcagttagcagagtctcagggagaaaggcaattagcaggtgcttccagggatcagagagaaggctagtttccaggcttggtgatggcgtgcactgtgaaacctgccagaggaactcatctcttatctgcccaggcactgggtgtccctggaggaggtgaccaggctaggtgggcactggcctggaatatggcatggctgtgaccctcccagactcctcaggagggcttcaagttctgtct

SEQ ID NO: 20768 - DNA, 433 bp, Homo sapiens
ttatgaaacaccactttaaagcttagtatactagattagagcagtgattctcaaactttagtgtgccttaatatcgctatagggcttatgaaatcacaggttgcttggtctcaccctcagagtttctgattcagtagatcagtaggtagggcctgagaatctgcattttagcaattcccctaggtgatgcaaatggggcttgtctgaagccatactttgagaacccctggactagagcattactgagaaccctggtgtctttatgtgtgtttataaaaatgaatgtgtgttactaaatatgttatttgattttcaaagctaattttctgcttttatagttatcgtggtaaatatacagtaaattcagtattctaattagtttttcatataatcaattaggcaaactaccaaagaaaataaaatgacttattca

SEQ ID NO: 20769 - DNA, 670 bp, Homo sapiens
  misc_feature (670)..(670): n is a, c, g, or t
ttttattctccatagccaagacatggaatcagtccaaatgtccatcagtggctgagtggataaagaaaacatggaatatatacaaaatggaataataaacggccataaaaaatatcaaaatcctgtcatttgcaacatgaatgaacctggaaaacattatgctgagtgaaataagaaggagtgttaagtctgatattgaagaatccagtttatccaggtcagtgaaatccagaatgttctgtctggcatcattaattgtggagctgaagatgtgtagatttctaaatctataaacagatgtgatatacaggctgtatacatgttagggtccctgtacaaggttttcctttcatgtcattaaataaaaatactggcagctacaaaaaaaaaaaaaaaaaaaaaaaaaaaaaatttggggggggctggggcctgggaaaaaagttttgaaaaaccaattcggtggggggccggggcccaggaagggtaaccggcacccgtgggcacacagcgggtcccaaagggagaccggggacaagacatgggggggggtttcccaccatataaaaacggcggggggaacccgaggttttggaacaaccagaggagtccggggccaaagggacttccaagggggccaggaggcggatatatccggcgcagcggggggggn

SEQ ID NO: 20770 - DNA, 454 bp, Homo sapiens
ttttattctccatagccaagacatggaatcagtccaaatgtccatcagtggctgagtggataaagaaaacatggaatatatacaaaatggaataataaacggccataaaaaatatcaaaatcctgtcatttgcaacatgaatgaacctggaaaacattatgctgagtgaaataagaaggagtgttaagtctgatattgaagaatccagtttatccaggtcagtgaaatccagaatgttctgtctggcatcattaattgtggagctgaagatgtgtagatttctaaatctataaacagatgtgatatacaggctgtatacatgttagggtccctgtacaaggttttcctttcatgtcattaaataaaaatactggcagcttcttcttgtgtttctgaaatcatttggcattcacaactttaataatatgaacaaactgatttgtagtattgtttt

SEQ ID NO: 20771 - DNA, 961 bp, Homo sapiens
tccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaaccaaatagcttaccctctttaaatttcccttttacttccttacaaactccctaacaccatttacgactttgtcatcaatatggtcaactaagcttggtttgcatggctcctacttcctttcaccttccacttaggcagtgtctcccaagtcccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgtaaaaaaaatta

SEQ ID NO: 20772 - DNA, 335 bp, Homo sapiens
atgagatgcatgactgtgtctcgtcgtctcctcactgcggccccttggaggaagcgccgttggggtcgacatggctttcccgagttctgctacctgtggtctttgtctctttaccctgaagacctctttgcttgttccacttaggtcctgccctccaactctcctgccggtgtcagcggtgacctttattcatgggtccagtggacaccctaatgctgtctttctgcattctacaacttcatttggcagtgttgacttttccccactctttgaaacactcactgctggtttccttggcaggatgttcttctttccctccccccaccccttttctt

SEQ ID NO: 20773 - DNA, 331 bp, Homo sapiens
tgttgatcagcatttcctcatcctcaggcctctcccatcttaagcagcacctttgcgtgtccccctttctttccctatacttctgctacctgtggtctttgtctctttaccctgaagacctctttgcttgttccacttaggtcctgccctccaactctcctgccggtgtcagcggtgacctttattcatgggtccagtggacaccctaatgctgtctttctgcattctacaacttcatttggcagtgttgacttttccccactctttgaaacactcactgctggtttccttggcaggatgttcttctttccctccccccaccccttttctt

SEQ ID NO: 20774 - DNA, 385 bp, Homo sapiens
ctgctgctgtggcacatgcaagtagccatagacagtacagaacccaacaaaatttcatttgcaaaaacaggaggtgagctgaatttggcgagggggctgtagtttgctgcctgcaccttgctataaggtctcacacctagtaaatactcaatggatacagtcattgttattgatgttatctatcaaaatagctttaacaatatatgataataatatacatacatctctgagccaacttctccagtacagacacaaaatcgtggagaacagtgattcttcaactttaccgtgcatgagaatccatggaacttcttaacaatgcggaagtggcctcatcttcaaagaacctgatgcagataatctgagttagagcccaagaactggc

SEQ ID NO: 20775 - DNA, 363 bp, Homo sapiens
agcctttcatagcctgaggttccatccacatggaaacttatacataatgtgacacatctttacattcttccattcaaaacgcttcaaagttactgccattatgaaggaataacttcttcaagatcatggaaccccaaagggtttctttgtgttctttttgacagctaattttatagatggggtctttgaaaatgtgattcttggattgctctataacttcccttgcattatctttttagtcctctccaagtggactttcactcttcactgggccagaaccactcctgccactcacccccatggggccgaatccgggggtcatttctcagtcttcatcttactctgtctgcatcattgacacag

SEQ ID NO: 20776 - DNA, 329 bp, Homo sapiens
gacaggacttaatgggaatggttggtttctgctccaagatcagcctcaactgaaaagattctaatggcaaggggttagaattatctagacgttttcttcacacacatctagatcctggattagaatgactcaaagactgggctcaactgggaatgttaaccaaagaacctgtgtatgacctctctgtgaggcttgggcttccttacagcatggtggccttggggtagtcagctatcagagcttcaaaatgagtgttccagtgaacaagtcagaagctctgtggctctttgtatagcctcagaactcacacagtgccacttttaccatgt

SEQ ID NO: 20777 - DNA, 351 bp, Homo sapiens
ctactactactaaattcgcggccgcgtcgacaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatgcacaattcatatgattactgaggtcgacgcggccgcgaatttagtagtagtaggcggacga

SEQ ID NO: 20778 - DNA, 443 bp, Homo sapiens
ccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattaca

SEQ ID NO: 20779 - DNA, 1596 bp, Homo sapiens
  misc_feature (586)..(586): n is a, c, g, or t
  misc_feature (592)..(592): n is a, c, g, or t
  misc_feature (661)..(662): n is a, c, g, or t
  misc_feature (666)..(666): n is a, c, g, or t
gcctttgtaacaataaatagtgatagtgttgttttcattcatctcatccatttataagtctaggtattagatctaagagaagataccctctgcatccaactgctaaagcagggaactgggcaaggagctacatccttcatcaactatccagtcaaatgcaagggaaagggctgaagcagcaagcaaatgaactcagaagaggtgaaatcaatgaatttcatgttctttccattaccatttgctaggtcagcctagctatcctcatggtcaaagattaataaacagaaataaaaacaaattcaccattgctaggcactacaggaagctaaaaaggaaatacttgaagattcagaaaaaaataaaaggaacacttacagtgatttactaccaaaataaaaacatttgtgtttctcgataagtattgtattcccggctcctaaaatctttgtatgacagatggtcagcattcaataaatatacattgaattagtgaataatcttttagaaaatgattccatatcctcagtgggtggcaagaagtctttgaatccataaagcatgaatgtaaggctatagaaagaataanctgagnccaaaaaatatatagagagagaaagagagaaaagaaaagaaagcaagaaggcaagcaagaaagaaaaanncagnaacaaaagagaaagaaatgaaaacaatgtacaaagtaagaaaatatgaaaaatgaaagtgcaattgagggattaatagatgcgtgtaaataaaattttccacatatataagaatttttccatagatagatagatagatagatagatagacagacagatagatagatagatagatagatcctactctaggtctataatttgtcttttgatgtcatgttattttttaataaacagaaatatttattatataaaaaaatctctctctccccccatggccccttcttcctggtttctagtttttatgtctgacttagaaaaacccttatcaaactaaaattatctttctgattttccctaattttatatcatatttttaattttaatctttttaacctaactgaaattttttattatgtctgatgagcaatttgtgtttaataaatgatattaaagaaagaaactttggaagaagtcactgatggtggcttgtaattacagactaagtaatttggatcatgattccttccaaagacatcttaaaagctgaaaaattataaaaataatctctttgtaggctttggagaattaagaagatggtgagaaaatagtgggcaatgatccataagaagataaacatctcaggccgggagcggtggctcacacctgtaatgtcagcactttgggaggccgaggtgggcagatgcttgagctcagaagttcaagatcaccctggctaacatggtgaaaccctgtctctactaaaaatacaaaaattagccaggtatggtggcaggtgcctgtaattccatctacttgagaggcttaggtaggagaagtgcttgaactggggaggcagaggttgtagtgagccaagattgtgccattgcactccagcctgggcaacagagtgagactccatctcaaaaaaaaa

SEQ ID NO: 20780 - DNA, 411 bp, Homo sapiens
gtcctcttggaaaaggaggctacagatggagccatcgtagggcagtggtgcccagaggagggggcctcccagacacacttcatgggtgtagaagttcatgagatggcttttgtcttacaaagtgtgtcactcggccaggtgcggtggctcacgcctgtaatcccggcactttgggaggccaaggcgggcagatcacgaggataagagatggagactatcctggccaacctggggaaaccccgtctctactaaaaataccaaaactaggggggcatggtggcgcgtgcttgtagtcccagctactcgggaggctgaggcaggagaattgcttgactccgggaggcggaggttgcagcgagccgaggtagcgccactgcactccagcctggcgacagagcgagactgcatctt

SEQ ID NO: 20781 - DNA, 362 bp, Homo sapiens
cttagggactccgagctaggtgagaagtccacccttccctccacctacttcctccatggccaaaattctgccttccctctctgcctggctgtctctcttgaaatctgtattcttttcagcagataatgtcaataagccctttatgtgagtaggatttggagcttctctgtttctcatctgaaaatctgccctgtgccagtgagtttgggcctctggcccacacgttaattattgtaccaggattcctggagtcgactggggacagagtgcctctttggttagaagaggggtattctggcagtatttcttttttgaggcattaatctagcttagagaggctgagcaagtgaaaatcgttgtgt

SEQ ID NO: 20782 - DNA, 922 bp, Homo sapiens
gagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtt

SEQ ID NO: 20783 - DNA, 390 bp, Homo sapiens
  misc_feature (29)..(29): n is a, c, g, or t
  misc_feature (107)..(107): n is a, c, g, or t
catttgagccccgggaggccagagggttncagtgagcccaggacttgcgccaactgcaattccagcctggggtgaccagagagggactctgtctcacaaaaaaaaangaaaaaaagcctgaggcaagaggatcactggagcccaggagttccaggctgcagtgaaccatgattgcaccactgcactccggacctcaggtgatctgcccgcctcagcctcccaaagtgctgggattacaggcatgagccaccatgccccgcctgtgagtaagtttttatcaatcaatgaaatgatctataagccatacacattaactgattaaaacaatcccttggtttaaataaaaagtacagaaatacctttatatagcatcatctttccccccaacag

SEQ ID NO: 20784 - DNA, 1041 bp, Homo sapiens
caggtctgtttctttattctgttgccctcgtggagcatggtatgttcccttcctaagaaggtttagaactccccttgaggtaaaaagctgcctacatttctgtaccgtaccttacatttgggtggtttttctccccagtctctcctgactcaagtcttgattttcttttgctttatcagaatcttacactttttggttccttttattagttattcatccctctccaggagctctttattacccaataatttacaacacagggaagtgttctgtgacccttttaacccttcttgagcatgataacccattgcacataaaatatatctggttttggctttgctgagtaacgaaaataaaatatatctggtgattgcctgtaagtgggaagactgcagggccctgcagcagcctcctcagcttcctctcctttatgggatccttctagcccactggctaaaatagaaatagaaatgaatattcctgctaccaccttgacagtccccattttaaccattctttagtacctcaccagccccttggctgacccactgcagtaatagtcctgccttcaacttccatgtgccagctctaagaacaacagattgtaaacctctcaacaactaaaaaagaaaaaatatctgaggattacaaagcatccattttttccctatcttctaacatctgttgcacagatagtcctgtttactccagacttggtcctcataccctgtgtaattaccttctaagaaaattgccactagttggtgggcatggtggcttaggcctgtaatcccagcactttgggaggctgaggccggcagatcacctgaggccaggagttcgagaccagcctggccaacatggcaaaacaccgtctctactaaaaatacaaaaattagctgagtgtggtggcacgtgcctgtagtcccagctactcgggaggctgaggcacaagaatcacttaactcggggcgcagaggttacagtgggtcgacatcacgccactgcacaccagcctgggtgacagcaaagctctgtctt

SEQ ID NO: 20785 - DNA, 423 bp, Homo sapiens
attttttaaaaatacataggctttattctagaggtatgcattccattttgtttttacatccatgggtagaccctagaaaataatatttaatagggtgcactggggtaaagagaaaagtttactaatagactgtgaaagaggaccagcccatgtctgcctcagcaagcacacccagcaccccaagggctgagaagattcaaatctcaatagattgcaaacttcttaatttcctaacatagcaatgttcccaggaacactggatgaacagctctactctagaacagagattataaaatttagctgcatattagaatcttcccaggagcttttaaaaaactctacgcctaggctataccccggaatgattaaattagaatatctgacagtaggatcaagacatcagtgatttataaaaaaaaaaaa

SEQ ID NO: 20786 - DNA, 388 bp, Homo sapiens
tcatttgccaaactcatgacagatggtttaacaggggggctactgctcccagggaactgtcagataaatcctcatttccagtgcagcagctgttggcagtctttcatcaaaagtccatccatctggagttacctattgtgattggccaagtagttttgctttggctaccagggcttcgttctgttgaatatgatattcctgaaatctcttggatattctttgtgtcatttaaaaataatttttgtgggaggccaggcgcattggcttatgcctgtaatcccagcactttcatgaggcccaggcgggtagatcacctgaggtcaggagtttgagaccagcctggccaacatggtgaaaccccttctctactgaaaatacaaaaattagc

SEQ ID NO: 20787 - DNA, 2365 bp, Homo sapiens
ggattaattcatgatggacaggtgaactccagaaaagcagtcacccttggcagctttcgtccatcgagcgattctgagagagggaacctctggggtgagccccgaaacgttaggttgcgctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacgaatggcgggacaggcagggcttttgaggaggtgtggatttcatcctccatcataaacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcctaaaaaaaaaaaaaaaaaaggcacctctcctaaaaaggactccaaacgctgtcctgagatcagttttaacctcgtctttcgggccgaaagtagttcacatttcccgagcacaagcatggagattttgaggtgcccaggttagaatttgcgtgtcgtcctcatgatccccaaatgcacttttattccccgagaatcttgcctcccggtggctagtacagtattgtttccttcttgatcatttgtgaagggctggaagctcggggccatccagggtgtttctccagcagcagccgccctgttctcctctctagaatcggcttcctgttgagcggtaactaacctggctgcttagaaccaggtgcgggacctggttagcactgcatcaccagtgtcacgggaaagaggtactttcctagctccccagagacgtaagaatctctctgatctcttattcttgtctagatcagcagggatgaagctatttgaaacagaaaaatgttttcttccctcgaatactctgtgaaaag

SEQ ID NO: 20788 - DNA, 2419 bp, Homo sapiens
ggattaattcatgatggacaggtgaactccagaaaagcagtcacccttggcagctttcgtccatcgagcgattctgagagagggaacctctggggtgagccccgaaacgttaggttgcgctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacgaatggcgggacaggcagggcttttgaggaggtgtggatttcatcctccatcataaacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcctaaaaaaaaaaaaaaaaaaggcacctctcctaaaaaggactccaaacgctgtcctgagatcagttttaacctcgtctttcgggccgaaagtagttcacatttcccgagcacaagcatggagattttgaggaaaatctcccgggccctgtgaagtacaacgtgtcttatcttccccaatgtcaggtgcccaggttagaatttgcgtgtcgtcctcatgatccccaaatgcacttttattccccgagaatcttgcctcccggtggctagtacagtattgtttccttcttgatcatttgtgaagggctggaagctcggggccatccagggtgtttctccagcagcagccgccctgttctcctctctagaatcggcttcctgttgagcggtaactaacctggctgcttagaaccaggtgcgggacctggttagcactgcatcaccagtgtcacgggaaagaggtactttcctagctccccagagacgtaagaatctctctgatctcttattcttgtctagatcagcagggatgaagctatttgaaacagaaaaatgttttcttccctcgaatactctgtgaaaag

SEQ ID NO: 20789 - DNA, 477 bp, Homo sapiens
gtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagca

SEQ ID NO: 20790 - DNA, 507 bp, Homo sapiens
ggcgcttgcttcaggtggagtctgttagtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcaggtggggtggcgtgagagtcgaggcctggaggtcggggagggttagctacgtgaagaggggattctgccgcgcttcaggtgcctggaggggatgcccgagctcttccgcagggctagggtgaagccagccagggcctgggggaaaggtagcagaggtttgccatggcttggtatttgagggactttacacatcgtattaagggtttgagcttcaacttggggtcgtcgggagccattgaaggttttttgttgtttgttttttgagacggggt

SEQ ID NO: 20791 - DNA, 890 bp, Homo sapiens
caaggttggggcaagatagaaaaactatttgaagaaataatgggcaaaaacatacttgaggagaaactcatccaggaatcccaacaaaccctaaatagcataagtacaaagagatcttgacctagatacatcatagtcaaactgtagaaagccaaagaaaagaagaaaatcttgaaagtagcaaaagaaaaacaactcagcacatctggggagcattaataagatgaacagctgacttctgactcgagacaatggaaacaaaaaggagttgaatgatgttaaaagtatccaaagaagaaaactgccaacccagaattctataccagtaaaaacagtccttcaaaaatgaaagcaaaaaagacattgtcaggtaaacaagactgaaggaatccattgctggtagacctgccagttcttcagcctgaaaataaatgacacgttggcagcttgagtctatgagaagaaataaagaacactggaaatggtaaatgcatgggttaactggaaagacttaactagttctgcagtctggaagccaaccaaaggctttgaatgatttgttgggtttataatatccacagataaaatatatgtcatattagtacaaaagatggggaattaaatggagcaatattggagcaaaatttctgtatcttactggaatcaagttagcatcagtcttatatagattgtgattaagatgcttactgtaatgcctagagcagctctgaacaaaataactttaaaatatagttttttaaaaaaatcagggctgggcacagtggctgactcctgtaattccagcactttgggaggctgaggcaggtggatcacaaggtcaggagaccaagaccatcctggctaacgcagtgaaaccccgtctctactaa

SEQ ID NO: 20792 - DNA, 951 bp, Homo sapiens
caaggttggggcaagatagaaaaactatttgaagaaataatgggcaaaaacatacttgaggagaaactcatccaggaatcccaacaaaccctaaatagcataagtacaaagagatcttgacctagatacatcatagtcaaactgtagaaagccaaagaaaagaagaaaatcttgaaagtagcaaaagaaaaacaactcagcacatctggggagcattaataagatgaacagctgacttctgactcgagacaatggaaacaaaaaggagttgaatgatgttaaaagtatccaaagaagaaaactgccaacccagaattctataccagtaaaaacagtccttcaaaaatgaaagcaaaaaagacattgtcaggtaaacaagactgaaggaatccattgctggtagacctgccagttcttcagcctgaaaataaatgacacgttggcagcttgagtctatgagaagaaataaagaacactggaaatggtaaatgcatgggttaactggaaagacttaactagttctgcagtctggaagccaaccaaaggctttgaatgatttgttgggtttataatatccacagataaaatatatgtcatattagtacaaaagatggggaattaaatggagcaatattggagcaaaatttctgtatcttactggaatcaagttagcatcagtcttatatagattgtgattaagatgcttactgtaatgcctagagcagctctgaacaaaataactttaaaatatagttttttaaaaaaatcagggctgggcacagtggctgactcctgtaattccagcactttgggaggctgaggcaggtggatcacaaggctggtctcaaacttctgacctcatgatctgcctacctcggcctcacaaagggctgggattacaggcatgtgccactgtgaacatccataattttctttaacttctctgctact

SEQ ID NO: 20793 - DNA, 1413 bp, Homo sapiens
gcggtggagcttagccccttcttccgaaagtcaggttggaggcggcctttaagcgccgcgcgtctctcggaacttaaatattacccggaatcgtctctgtgaattggaaagcccattgaagcctcagagaagccgcgccattgcggaggcacgtaacgtcaagcagggacttcctgcgtcctcgccgcggtggccattttggcttgtcgggaccatccacctatgctgcgtctgtacctctttgtcaggaccgagagcgcgcgagaggagtggttgtgcccattgcacacaggcggatctgaggcttggcgacgccgctggtcgcgacctgggacaggacgagcacaggaaccgcctggcctgcgtccccgcccgcgcatgaagtcgtggcggcggccgctcaagtgagccctgcgacctccaggcctcacccgccatccccacacagaccctgagacccctgactgtgaggggcgcttcctcgcgtccttgcagctcaggcctctgtcagggacctagaggcgccggcgggtggaatccctgtttccgacacccggttgatgcggtcgggagagcgagactggccgagggaccggcttaggcaaaggcctggaggcacgactgcgccaggaggattcggaacacagggacatcttgtgtccactgagaacaaagtatgagtcggagttatttcctcagtaccaggctgaggattgatctttgtgaggaccgtagaagccatggacagttttgaacaaaggaggaaatctgtgttagagttaaagattccgaaaagatgttcaaaggaagaacggagtgtaaggcggtgatgaggacagtgaggcattgagaggttgaatatttgctcaaggtcacgtagctggtaagaggtgacattgagcactgggccacaagattagagactcagcctgaggtcacctggctacagggccaaaaaaagcttacagagaaacctgagtctatcaaatcccagcagggacacattcctgaaagctccgccttttggcacaccttctcatggctatggaagtatttaaggaacccacagaaggaagtataggatgctctagtccctcactggtcctcatcctcacctatatgtctagatcttaatgtcctgggaatttatttatttagcgacagagtgtcactcttggtacccaggttggagtgcagtgacgcgatcatggctcagcatagtcttgacctccccaggctcaggtgatcctcccatctcagtctcccgagaaactggctaatgtttgtgtttttaatagagacggggttttgccatgttgcctaagatggtcgaaaactcctgggctcaagcaatcctcccgccttggcctcctaaagtgctgggattacaggcgtgagccgctggtctggcca

SEQ ID NO: 20794 - DNA, 1207 bp, Homo sapiens
gcggtggagcttagccccttcttccgaaagtcaggttggaggcggcctttaagcgccgcgcgtctctcggaacttaaatattacccggaatcgtctctgtgaattggaaagcccattgaagcctcagagaagccgcgccattgcggaggcacgtaacgtcaagcagggacttcctgcgtcctcgccgcggtggccattttggcttgtcgggaccatccacctatgctgcgtctgtacctctttgtcaggaccgagagcgcgcgagaggagtggttgtgcccattgcacacaggcggatctgaggcttggcgacgccgctggtcgcgacctgggacaggacgagcacaggaaccgcctggcctgcgtccccgcccgcgcatgaagtcgtggcggcggccgctcaagtgagccctgcgacctccaggaggattcggaacacagggacatcttgtgtccactgagaacaaagtatgagtcggagttatttcctcagtaccaggctgaggattgatctttgtgaggaccgtagaagccatggacagttttgaacaaaggaggaaatctgtgttagagttaaagattccgaaaagatgttcaaaggaagaacggagtgtaaggcggtgatgaggacagtgaggcattgagaggttgaatatttgctcaaggtcacgtagctggtaagaggtgacattgagcactgggccacaagattagagactcagcctgaggtcacctggctacagggccaaaaaaagcttacagagaaacctgagtctatcaaatcccagcagggacacattcctgaaagctccgccttttggcacaccttctcatggctatggaagtatttaaggaacccacagaaggaagtataggatgctctagtccctcactggtcctcatcctcacctatatgtctagatcttaatgtcctgggaatttatttatttagcgacagagtgtcactcttggtacccaggttggagtgcagtgacgcgatcatggctcagcatagtcttgacctccccaggctcaggtgatcctcccatctcagtctcccgagaaactggctaatgtttgtgtttttaatagagacggggttttgccatgttgcctaagatggtcgaaaactcctgggctcaagcaatcctcccgccttggcctcctaaagtgctgggattacaggcgtgagccgctggtctggcca

SEQ ID NO: 20795 - DNA, 763 bp, Homo sapiens
acttttttaggggacaggatctaggtgggtgctggtaggctctcctttgggttggggaatggtcctgaaagggaggaaccaaaaaaaacagccctccacctcccccgcccttttttaaccctttgcagttggccacctagtgggggaacacggttgtgtttttaaggattcgggggctggaaaagttttcactctccctccattctaaaattattttttggaaaatcactgggtctgatggcactggacccttgcaagtttcgctggttcctcctgttgcccagggaatctgcccccgacatttgctgctgtagatatttgtttgcctgatagatgctttttttcttccctgagcatttggttgcttcttttataatgctttgcttagagtgggcaaagtgatatcaattccacccgccccctccaaattgttctccccagtagtttttcaccaacgtgaatttactgtctgatattggtgttcgttaggccaacaaattgggtttttttcccagagccttggagaagagagctgcaggctggaagcttgtgtggagtgaccgactcccattggggcagaattacagtgattgaaagtgctcaagaatgtgcctttcacttttttttttccttttaaaggctttttcaattttgctgtgagagtttggtcgtcatctcatggtgagaaaatagctcttgatgatgccttggaaatggagagggcctgcggaagcagggagagactgacacgtgaacaagaaaa

SEQ ID NO: 20796 - DNA, 407 bp, Homo sapiens
caattttaaattttgtggtaactacatgaaacaagttgaaaaagtactaattttagtagtatccttttattaacttagcatatccaaaatattattttaacacgtattcaatatgaaaaaaccactaatgagatattatacattttttctggtactaagtgtctgaaatctggtgtgaatccggtgacagtttgcattttacagcacacacctcagctcagactagcacatttccagtgctcagtagctacatgtgcttagtgactaccatattggacaacataggcttagagtatattttattttatttgaaaattggcaattagtatataatgtcgtggtaacttttttctttttttctttttttgtgacagagtctcactctgttgcccaggctggagtgcaac

SEQ ID NO: 20797 - DNA, 447 bp, Homo sapiens
actattcccagtcttttgctatacaaaagtttccttgtgcatatataatatgcttttgccagtgggtctttagcatagatttctataaatgggattgttaggtcaaagggtaaaagaacatgttattttgtttaattctgccaaattccccttcataggggttgtgcagttttgtattcacaccagcagcatttcctgtttctctgcagcctctccaatagaatgaattgtcaaactcctagatgtttgctaaatcgatatgtgggaaatgttatcaaagtgtagttttttttttttttgagacggagtctcactctgttgcccaggcggaggttgcagtgagccaagatccggccactgcacttcagcctgggtgacacagtgagactccatctaaacaaaataataataaataaaataaaataaaatgtaaaagcaactcctaaa

SEQ ID NO: 20798 - DNA, 522 bp, Homo sapiens
  misc_feature (64)..(64): n is a, c, g, or t
agagacagacaggccagagacagacaggcgagactgtggaaggccagggagatgctgcctctgnctttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20799 - DNA, 3014 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20800 - DNA, 3150 bp, Homo sapiens
aagttgaggctcaaactgcgtaatttgtcccaagttacaaaggtgaatgccttcaacaaatcaaagtcccgaaactctcaccttctccagatctgggtcaaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagtaaggaccttctccccacaatgggtccctaggcaacaaccatcaccctccctccttaagcttctgatagcaggcactggtatctcagtttacatgtgagtgctagttggggaagaggtctgatggctgggaaaataaccacactgggatgaccttactcttttccttctgaaattgggtcctcctccaactgggggttttaaacctttatttggactctgggccctttgaataagctctggacattctctttagaaaagtacatatatgcataaaactcctgcaggcaatcacaaggaagtcatgtatctctgaaagccccagactttttcaagtgtagtctacaaacctcctataccagaatcacctgagatgcttgtttaaaatataggctcttgaattccactccaaatatgctgaactaaggtatctgggggagcagggcctggaaacctgcattttagttaagtgttccaggggattctgatgctggtgatctcatacctgaagaagcctagttctgctagagattctcagactgtgggcatcaatcacacagcaagcttttcaaaggaggactccagatacggcaaattgcaggtttggagtggcccccgggagatgcattggtagcaactccccagcttattctgatgcagatggtcaggatggtggtgacaggtgtggggtaggagggctgagaaatgtgtgaggctggcacaaatgaaatgggatctgcacggaagcctccagcatgggcactgcagtgccgtcctctctcttctaggttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20801 - DNA, 2978 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctctttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20802 - DNA, 2912 bp, Homo sapiens
ctggcggatcacaaggccaggagatcgagaccatcctggctaacacggtgaaaccctgtctctactaaaaatacaaaaaattagccgggcgtggtggtggaagcctgtagtcccagctactcaggaggctgagcaggagaatggcgtgaacctgggaggcagagcttgcagtgagccaagattgtgccactgcactccagcctgggcgacagagcgagactctgtctcaaaaaaaaaagaacaaacgcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctctttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20803 - DNA, 2443 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcaccaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20804 - DNA, 2958 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20805 - DNA, 2960 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactataggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20806 - DNA, 2833 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20807 - DNA, 2550 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcacttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20808 - DNA, 3880 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaacaaggaaactgaggccaggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagtaaggaccttctccccacaatgggtccctaggcaacaaccatcaccctccctccttaagcttctgatagcaggcactggtatctcagtttacatgtgagtgctagttggggaagaggtctgatggctgggaaaataaccacactgggatgaccttactcttttccttctgaaattgggtcctcctccaactgggggttttaaacctttatttggactctgggccctttgaataagctctggacattctctttagaaaagtacatatatgcataaaactcctgcaggcaatcacaaggaagtcatgtatctctgaaagccccagactttttcaagtgtagtctacaaacctcctataccagaatcacctgagatgcttgtttaaaatataggctcttgaattccactccaaatatgctgaactaaggtatctgggggagcagggcctggaaacctgcattttagttaagtgttccaggggattctgatgctggtgatctcatacctgaagaagcctagttctgctagagattctcagactgtgggcatcaatcacacagcaagcttttcaaaggaggactccagatacggcaaattgcaggtttggagtggcccccgggagatgcattggtagcaactccccagcttattctgatgcagatggtcaggatggtggtgacaggtgtggggtaggagggctgagaaatgtgtgaggctggcacaaatgaaatgggatctgcacggaagcctccagcatgggcactgcagtgccgtcctctctcttctaggttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20809 - DNA, 2103 bp, Homo sapiens
ggcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagagatgaaaggagaagctggacatatgctacacaatgaaaagtcaaagcaggagggacacatctggggctctatgaggaggacagctttcatcctgggctctggacttctctcatttgtggccttctggaactcagtgacatggcatcttcagagattttggggtgcttctggctacttttggcaagcccagtgggagaggctgctgactacatttgaagggaaggagtggatcctcttctttataggtgccatccaagtgccttgtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggctccttcaccacccaacattctacaagaaaatccacaagaaacaccatgagtggacagctcccattggcgtgatctctctctatgcccaccctatagagcatgcagtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaatggataatttt

SEQ ID NO: 20810 - DNA, 447 bp, Homo sapiens
taaagatttgatggtgaaaagtgctctggagaaaagtcaagcaggcacaggggaaatggcaagctgagatttggctgagggagtaagtggtcatggtgggcctaaagaataactggggaaaggtgacattttagcaaataagtgagggactgagccctgtagaagtaaaggaaagatcagtcttggtagagagaatatccccaaggcccttgttaagtttcattttattgacaagattttcttgatcagactatgcatgtctatactgagacatgttatagaagatgaaatatatatcagttggaataaaaatagtttaaaaatggccaagtgtggctgggtgcggtggttcacgcctgtaatcccagcactttgggaggccgaggattccttggggccaggagtttgggaccagcctggccaacatggtgaaaccccgtctctact

SEQ ID NO: 20811 - DNA, 344 bp, Homo sapiens
tttttttttaaacggagtctcactctgtcgcccaggctggagtgcagtggtgcgatctcggctcactgcaagcttcacctcccgggttcacgccattctcctgcctcagcctcccgagtagctgggactacaggtgcccgccaccacgcccggctaattttttgtatttttagtagagacggggtttcaccatgttagccaggatggtctcaatctcctgacctcatgatccgcctgtcttggcctcccaaagtgctgggattacaggcgtgagccaccacgcctggcctgtactaggtacattttaagtgctcaatatccacacatgactagtggctattata

SEQ ID NO: 20812 - DNA, 314 bp, Homo sapiens
cccacttctctaacctctttctccacccatcctatccctggctacctgagttccaaacaaagaagacctgccttccattcctcccctgggtcaaaatctctcaaatgcctcagtgtactagtaacacgctgctcccttctgcctagaaatgttatttcttggattttcttattgcttggatgtctctttttcatcgcttcagttccagagccttccctgaccactctggctgatgctgcctcaacaactgtggcagaagctactggttgtgcacaatattcttctcgttcctgagcacatggctacacaacact

SEQ ID NO: 20813 - DNA, 818 bp, Homo sapiens
atgtcccaagaaggacacatttttataaacataagttactattgttatatatatgctaacgtttgtctagaaaaagtctagaaaaatacacactgaactgtgaatagcagttatatttagaaagcaacattaggatggacttaagtcagggctcggactagagcaaggcaagtgaggtgccaggatgcaaaagttaaggagacacctgacctcaggggcccacaactgcagagcccctgacagtgagtgtctcagtagcctcgccctagtcctggctttcacttaaatatgttttcgaatgtttgtaataaaatatttcttttggaaggcaaaaatagcaaggaaaataaataggattaaaggatactaaagcccattcaataaaatttgtaggaggccactgatttggcctaggctcctatgatgtaaccaacagaccaaaccaatatggagtcattcatgctaaatgaaactagttaggagtatattcatataacaagtggctaagtgtcagttacagcctctgagctttagtcaattgtaggtggtcaatagattcagataaggcaatccagttaaactgtatatcccacttgctgttttctgtccctaaattctctctgagtacactgcagccctgaagttctttgaacctgttctgggttctgagggctgtccaattactgaatcatacataaaagccaagtaagattttaaaatttgttataattttggtttttaacaacttctgttgtaaataataaaagcactaaatccctactgaaaataaagggcctaaagactgaaaaaaaatgcaa

SEQ ID NO: 20814 - DNA, 617 bp, Homo sapiens
gggacaactacaaaggctgtaacatacacataatgggaatactggtggtgttgcggaccagttggaggtgaccaggtgggtgctatctgatggttttactgcctgtgccacatacaactgtttcctcatgatgatgccattttcataagttggatttcttcacgtgggcagacacacgagccattggcatctcacttagactcttcctatttcacacaaacttaaactttagtggtatttcctgagcttaacagaaaatgaagaaagcattccacatacctgttttggggtcctccccatttttcctaactctgcacagaaattagaagcagggagttctttctatatttactaacataacacacatcacttcttttaatttggcatccttcctccctttatgtaattgacgcactgaccagttctgtccttttaatgggactctctctacttaaggagctgctaatttccaatcacctttggcatctttctttgagcataatgtgatcctgctggaattcacggcacacctaaaccttattttggtctcaagagaaatactactaccagcaattgatcttcgatgtctggatcatcagtaaaagtttccacttatg

SEQ ID NO: 20815 - DNA, 528 bp, Homo sapiens
tgtgcctgagtagtaactttaatttgttgtcaagatggttttgagtcctgtgcggtttagtttcccactttttgtcttgcctccctggctataggcctgggggcaggaccacagtttcaagctcctgagtcttctgctgagtctggccagatacctgaggcccagtgggtgctcccacatccttttgagttgatggattttacaaggcaggggccaaaactccctactaaataattgatcaacacgcctcttggattttgtatccactcctgtgtgtagatatcacctgctgtatttggccctatctttgcttaaaaaaaaaaaaaaaaaaggtcttcgggggaacccgacctcgaatgacaactcaagctaagagctgatctgtgcggaaagccatcacccccactgacagcagaatcagaagcatcttgcagaaggctctgttgtcactcccaactttatgctctacctacagcgccttaacctacacgccttgtgactttccctgaggaggtgttggaccttgtt

SEQ ID NO: 20816 - DNA, 669 bp, Homo sapiens
caggctggtctcgaactcctgggctcaagcagtctgcccgcctcagcctcccaaagttctgggattacaggtgtgaaccaccatgccccgctgccccttctttacttagctatattttccttactaagagttagttccctagcccatcagaaagattcccaggctggctacttcgggatgacccttgcattttttattgaaatcatttctgaatcttttttccccactagcttttaagacataggaactatatcttgttcagctttgcacttccaattataaaaaaatgcctggcgtgtgttaggcactcagaaaatgtttgaactgaaccaatggtgtgtgtgtctctgcacactctaagttagtgtaaatcagaacagcttgttgttgctgcttgttttgatccaagaccaaagagtgattgataaatgtgctaagtattttctgtgttcttaagtatgtttggtgtaacataatttggcatacacacatattaaattgccttcattcttaaaaaaaaaaaaaaggacaacaacatcatgcctttagattatgtggaacccctgaattttttctcagggtacctgccagggagtggtccctttttacagtataactaaaaaaacttctgcttgtatttattttgtaagttcagccgctcagtcgaag

SEQ ID NO: 20817 - DNA, 431 bp, Homo sapiens
taacctctacatccaaattaggaactgtctaaggctgaccccttttacagtggtgactcaagacccagctagattttgggaattctaatgtgaattcatagagttctaatgctagattaggaactctaatgtgttctgatgttaagaaggagtgtattctgtgttattcacaggaatggtgtagagattagtaaagatgtggatagccaaagagaagttgagcaacccgtagtattttactcactgcagcaaaatgttttgataaccattttagagttgctctgataggtttcaagctgggagataattagattttattttaaaatatttctattttttgtagagacagggtctcgctatgctgtctaagattgcttgagcccaggcatttgaaaccagcccggacaacgtgatgaaaccctttctcttcc

SEQ ID NO: 20818 - DNA, 279 bp, Homo sapiens
gtctagatgtacatagtactgccaaattgcttttaagaaagattatgtcaacttagactgtcactggcaatggatgaaagtacttcctactttgtttttatctatattgccttaaaattatgattttaaaaatttgcaaattagaagatataaaaattttgccaggtgcattggttcacacctgtaatcccagcgctttggaagaccaaggtgggaggattgcttgagcccaggcatttgaaaccagcccggacaacgtgatgaaaccctttctcttcc

SEQ ID NO: 20819 - DNA, 837 bp, Homo sapiens
tggtcccagtactctagaagggcacacctctgtcctggaaaataatacaagaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtatgaattggtcaatgaataattactaaatatgtgaatatttactggattgtatggatcctatgaataattactgaataattattgtgattgcttttattggcagtgctgaaaactcatccctttgtgacctcaagtaacccatgacactttgtgaacctgcagttttttcatttagaaacttgacagattttcattctgacacagaatgtcaggtctcccagaccctagaaaatacattgacttaaagcctttgatacatctcaaagcagtatccttacagtgtcactggaagatggtgcgggctgcagagagggatgctttcaaatgggattaaccagtcctccttccttcacttccacatgaatgctgggcagcccagggtcaacccactgcaccctcaactcaggcaagtccagcagccaatcttaggagacctgggctacagaacagtctctcaagttccaggctcacaaaacctaggtggggatgaaagctgagaaagcgaagaggtggttcaggggatcactctttcctacttgttcctctcacctcaaactcaccttctactgcacagcaacact

SEQ ID NO: 20820 - DNA, 762 bp, Homo sapiens
tgagatggagtctcgttctgttgctcaggccggactgcagtggcgctatctcggctcactgtaagttccacctcccgggttcatgccattctcctgtctctactaaaaatcaaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgcttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgattttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaaaaaaaaact

SEQ ID NO: 20821 - DNA, 1395 bp, Homo sapiens
aaaacagtgcaatacagaacagtggaaattggaaattccaatcttggaatctctaggaaagtaactgaggcatacgatgcctgaaaaggagtagaaaataaaattaataaggtgggaccatatgataagagatttgaggccgggcactgtggctcacacctgtaatcccagcactatgggaggctgaggcgggcggatcacctgaggtcaggggtccgagaccagcttggccaacatggtgaaaccccgtctttactaaaaatacaaaaattagacaggcatggtggagcatgcctgtaatcccagctacttgggaggctgaggcgggagaatcgcttgaacccaggaggtggaggttgcagtgggctgacattacgccatagcactccagcttgggcgacagagggagactctgtctcaaaaaaaagacttgagcaagggcgtaatcttcaggaaggtcagtctggtagcatagtgtggattgggttgggggatggggaaggagagcagaaaattattgaaatatccaggtgcataaaagtctactttgattatggagaactacacacttgttcagtcaccctcattggagacgggggatggcatacgaaaagaatgctgatttcaggctgggcacggtggctcatgcctttaatcccagcactttgggaggctgaggcaggtgaatcaggggttcaagaccagcctggccaatgtggtgaaaccctgtctctactaaaaatcaaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgcttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgattttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaaaaaaaaact

SEQ ID NO: 20822 - DNA, 378 bp, Homo sapiens
gtttcgggagagaggaaaatatatgaaatcactgtctagaaatgagaaagaatggtcctgaatgtagcatcaatgccagtggtgtgaagttcttgcttgaagtcagtggtcattttaaagaataccagtcatcgtagctgaatgacatttccaatcacgcttagctgctcagctgcaggtccgtaagagggtgaagagctgcagctaagcaagtctgaggtcttaccaagacagtatgcaatgctaccctcccatcttctttccacagaacttcattatccacaaacagtcacatgatctcatttgatccaaacagccccttgatgtgtccgtctccattaggggaggaccctgaggctcaattaggttaaacgactt

SEQ ID NO: 20823 - DNA, 906 bp, Homo sapiens
gcctccagttctccagcagtgaccccagcaagccccaggagacagtcctgcaggcacaagccctggagtgtgctgggcctgctgtggccctgcgttggcatcagtgccaggcatgcccagaagcagggggtgcgacacagcactccgggtggcagggaaggggcctcggcgccctgcatgccgctgaggacttgtgcgagtcactggacccttcatcttggcacctgtcacttgctggagatggactcactttgccgtggtgaacactggaggcaacaggaggaaaaagcgccattcaaaagagaatcaaatgaaaaaagtcaccttgtttctatctgcctgtgattcagtctaaagattatcaggtggtagaagaggaagacgagaaacagacacctaggcccccatggaaggatcccggctgcagcttccctcgagagcacagcgtgggggatccactgcccaaatggtcatccgtgtcaaactcccggtgacagggaccctgctgccccaatccgcctgctcttcagggagggagtggggttttaccctgtccttctgcttccttttcatgggagaaaaggggcaaggcccggcccggccgacggaggacctggcaaggggagcccgcccacgcttcacctgtgctcagcagcgtgcgggagctgctgggctgtgcaccagaagcaggacagctggcaattccaggctttaccagttgccatcaggcaaaggagctccccaggcagaatctgcacggcgtcccatcagcccccacaccgtgagaggaacggggcaagccttggctctaatattagtcagctgcttggctccccgcagagtcactgttttattcccgctagagacttcagttcaaaattaagtgataaaaaaatactccagctc

SEQ ID NO: 20824 - DNA, 454 bp, Homo sapiens
tattattttttacaaaaagaaaggtgacaggaaccaaaagcaaagcctgtctcaacaatatttgtaattaatacccttaaatcacctgctttttacaccatcttgtctacttatagaacctttagagtagccttagaaactggctataaagccagggaaacgcaacaaagacaattcattattccaataaactacaggctattttcagtaacgtgaagcataacaaaaatatcaataacaaagatataaagaagaccaggtaacaaaacggagcttaagaaaaaaggagctgggtgcggtggctcacatctgtaatccctgcactttgggggccgcagcaggtggatcgcttgaggtcaggagttcaacaccagcctggctaacttagtgaaaccacatctctactaaaaatcaaaaaatcattagctaggcctggtggtgggcacctgtagta

SEQ ID NO: 20825 - DNA, 476 bp, Homo sapiens
gcaatagtgtcactgttcctaattccaagtggagaagaccaaggctaggcctggttatctgctgtctctgatacacacaaccaaaccctggtggagcctggtgtgggtttcctgactcttactcagcccagtgtcccctggtgcttcctggctccacggtccctcagttacctggtgccctgggggtgggggggacgcaacacaccccccccccaaccacatgctgactgagcttgtgcaggtacttcaccgcgttgtctcatgtccttgtctgtcaaatgggtgtaacattctctcaccatattggattgttctaggatgaatttaggagttttgaaataccctttttcctttgttttctcttcatctgttccccttttcatcatttgacagctgatcagtgcctctcatgaagaaatggagaatgattggcatgagtccctcagtggtgctccctgtgagcaccccagtgtccg

SEQ ID NO: 20826 - DNA, 385 bp, Homo sapiens
atttgtatctaagtgcctcattccaggaattcaggaatgtgttgatattagaaattctattaatatgatttatcacattgagaagtttgaaaaaatccataataggctgggcacggtggctcacgcctgtaatcccagcactttgggaggcccaggtgggtggatcacgaggtcaggagatcgagaccatcctggctaacacggtgaaaccctgtctctactagaaatacaaaaaattagccgggtgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctc

SEQ ID NO: 20827 - DNA, 384 bp, Homo sapiens
gagatggagtttcactgatgttgcctaggctggagtgcaatgccacgatctcagctcactgcaacctccgcttccaggttcaagcgattctcctgcctcagcctcccaagtagctgggattacaggctcccgccaccatgcctggctaatttttgtatttttagtagagatggagtttcaccatgttggccaggctggtctcaaattcctaacctcaggtgatccacccgcctcagcctcccaaagtgctgggattacaggtgtgagccaccgcgcccggctttttgatttttttaaactgtcattactcggggtttatagtctactactatattgctgagaacagttttcaagattaaaaataaaaatgttttctgtttctct

SEQ ID NO: 20828 - DNA, 142 bp, Homo sapiens
catttatctcctttgataaagttaggtgcttatgaggttgtgaactcaattctcaggagtataggttaacttctggtttagaagccaaactacattatacaccacaacacactagggacaaaaggggccctttgataagtca

SEQ ID NO: 20829 - DNA, 298 bp, Homo sapiens
gaaggctgaggcaggagaaccatttgatcccaggagttcaaggctgcagtgagctatgatcatgccactgtactccagcctgggtgacagagtgagactccattgctaaaaaaaatagtaataataaaagagaaaaaaggatttcccagataagcaaaagactgtttgtttgtgtcttgtttgttgtggtcttacaagaaatgtttaagggagtcctacattgggaagcaaaagaacaatatctaccatcatgaaaatacatgaaagtataaaactcactggtagttcagacacacaa

SEQ ID NO: 20830 - DNA, 328 bp, Homo sapiens
ttaacaaacatcttccccctctctttccgtgaaactaaaaccagttgtcaggggtcaattggagcaagtaggattttggattaattgttccgttctcaaaattggtcagtcatgcagcaggtaacaatagtaaacctactcagtgtagaaaaatagggttactgaaaacaccacatagaggctttcattttaagatatttctgggccaggcatggtggcttatgcctgtaatcccagcactttgggaggccgaagtgggtggatcacctgaagtcgagagtttgagaccagcctggccaacatggtgagactctgtctctactaaata

SEQ ID NO: 20831 - DNA, 677 bp, Homo sapiens
gttacttccagaaccacacagtaaggaaatacactgctcttttggctaccttacagtgatttggggaaggcttctagaatgtagcagatgtagacacttcctctcctgggctcctgccaaagcacaaggctttttgaaaagcctgagctgtctgaagaagagtctagaattttctgtttaaacatacttctattctaattttcttcatggataaatgctatttgcagaaaatacaaatgttttcactgttaacagaaggctaatcacaaatgttgtctaaacttttaactctgataagagagtttagatttgtcagaaaagaggttattttgccattgctaaaatatattgtcactaaagtttttttgtcatctttcattgtccttaaatctcacaaggaattaaaaaccattagcctacagaaataactaaaaagcagcttaagatggtatttttcttcgaatagcttgaaaatattttaagaatgacagagcctacataaaaattcaaaacaatcgtaaaaagaataaatatctttaccttacataatgtttcaaaatgaattctaggatggattaaatagttataatcaacaaaacaaagtaaaacaaatagcaacaacagaatagttatcagatctctaaaagcagagaatttctaaacttaaaaataagaaa

SEQ ID NO: 20832 - DNA, 811 bp, Homo sapiens
tagatttttagttgtattatcacactttcctggtcaaggaaatctccagccttagggtatgaagtcatccattttgaaactcttcagtcccttggcagggtgagatgctttgccatcataaaatggccatatagagtggcatgtggccatgtcagtgattgtaaggttaatattccgtaatgaccgcaaaggaaccactgtgcagccatttatcttaaacacaggaaggaaaattgttggctgatgcctaataaaaatgaatcattctgggtgtcaaagctcttttaaaagcttttaagaatgaaatgctaaatcagaaaggaagtatctgtaatctatgttccttaacaaacaatttatttttatttatctatttagattattattcttgggaaagattgagaatatttgtatttttattattatatttttatcttgtctttaaaaaatctaacgattttgatgctgtagttttagatgtaaagcatcttctgagaaaaaaagagaacattttgaattcatatcttaacctttgtaaaatgtaaacttattaagcctgaatctacccatcaggcacaaaatggtgtcaccatatgccctcctgggcagtagaggggccacagccagcattataaaaatcctggtaaatagctgattttagaggcagtggcagccagaagaatggagaagctgcaatatttatggttaaagacctctatccccacttctttctggacacctgtgggccaaattcttccctccttggccccactcctagccaagtcctcccctttcaggctgaacagtgaat

SEQ ID NO: 20833 - DNA, 443 bp, Homo sapiens
tcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaaga

SEQ ID NO: 20834 - DNA, 551 bp, Homo sapiens
aggaatgaaatgggtacagcgagccctaaaaatatttttagcccagaatcaagccgtagaggttgggacagctcctatccatgggtcacagtgtaaggatgataaattagaactcaataaacatagaaaacatacaccagtcagtagagtgcctgctggaggttaccttctcgtaggacattgatggaatggaggcccaagtttacagaactcctgagacagccctaaatgttgcttttaggttgaggcatcccagggtaagaaaataatttggatggggtacagaaacgaaaccaaaaaatcttatgggaaataggagagtggctttaataggatggatttaataggaaatcaaagttacatggataaaaacaaaggtagggtaagcctttggcaaagtgtcgcaacaaggttccctcaaggatgccataccctgtgaggaagagggtggtcatcttggtgctccctctccgggtggagggtgctcccggagagattgccagcctgcaggagtcattgcaaataaaaagactgcgcctgaatgtgcttta

SEQ ID NO: 20835 - DNA, 300 bp, Homo sapiens
tgtgtgtgtgtgcaaaacatgtctttgggattttgatatggatttgacaaaatttaacagtttttatgatagaaacattcaacagactaaaaatagaaggaaattacttcaacaccataaaagccaaataggaaaagcttacaactaacacactgaatgatgaagctgaaatttttcctgtaagatcaggagtaaggtaaggatgttcactctagccacttctgtttacatggtactggttttcctagctagagcaaataggcaagaaagaaagaaagaattgcaatcaaatcatataga

SEQ ID NO: 20836 - DNA, 368 bp, Homo sapiens
taaaaaatgacattataaaaaaccttattgcacttaaatattattattgttacatttgttgtccattttgtctcccaggccttccttaagcttccctgcaaagtatgttagttatattttatgggatatatcagttttgacaaaatatttcttcttcccaaattatgtagagtccagtatgaatatgatgaagtaaaatttttaatcaggccattccacaattcatttatacctatcacggtttcaaatctgccatttctccttaattttcaggccagctctttgtaaactggcacatcttcatacttttccagggttatccaatttttttgtctatattactccatcagtcacaatacttaggaatg

SEQ ID NO: 20837 - DNA, 652 bp, Homo sapiens
tgcatttcccttgagcatcttcaagaccctttgaaagaacagctgcctagcccaggcaacctctcttcttagcctacacggaagaaatgaaattcactcccaaagtgcgggtgttttcaggacccagtgaactggaacttgcagcgtcttctgcaagctccgttgggccggcctttcatgtgagcaggaaggaaatgactgacaactttctcgtctttatggaaggcggactttatttccagctctcaggtcaaaaggcggcggaaagaaaacaaaaccactaagagataaaggctaaaaataatgtcctgtggggtgaatcaacccagtttgggaccctgaagacagcaacaaggcaaggatgtgcgtagggctaaatctgcgtcatccttcacaggtggtcgtgacccagaatcaaaatgcctgggcaagagaggaagaagttctgcaaacaggtgtgctggagggaaggcgtggggaggggagaggaagaagccattgagtcgatcctgggcttgaagcccacacactttcccagcagttcacctccgggagagcccagggactggacatggcctcggaaggagctaaaagttgatttggggttttgtggtttgggtgaatgcactttcagtttaaaatataaatagat

SEQ ID NO: 20838 - DNA, 278 bp, Homo sapiens
cttaccctatctgtgccttatctgtgttaagttagctgctatcatcatcattattactataattttaaaattgtcattaatatagtcataaatattgaaaaggtacatcacccaaggctaacagccaccagtacttcgcaggtgaagaccaacatggatcttgggtctaattagtattggagaggaacaaatctttcacttttgtagtcattgtaagttttttctaatataaaggagacttgatgactaagcaaaaagagcaatttcatttcctgggt

SEQ ID NO: 20839 - DNA, 1146 bp, Homo sapiens
ctgggttcaagcagttcccttcccttagcctcccaagtagctgggactgggggcatgcaccaccgcgcctggctagttttgtatttttggtggagatggggtttctccatgttggccaggttttctcgggctcctggcctcgggtgatccccctgcctcagcctcccaaagtgctcccaaagttacaggcgtgagccacctcacccggcatgatttagataagactttgaagcttagacttttaagggtgatgctgaaacaaattaagacttcttggggttattaggatggaatgaagatattttggatgtgagaaagatatggattaggggagctaggggagaatgctatggtttgaatgtttttctcttctccaaaaatttatgttgaaatgtaatccccattacaatagtattgggaggtggggcctaatgggaggtcatgagggctctgccctcattaatggattaataccactgtataaagggcttactgccatgtgaggacacacatttcatccctttgtaccctctgccttgtgccatgtgaggatccagcaagaaagcccttatcacaccagatgtgggcaccttctgcttggactttccagcctccagaactgtgagaaatacatttctgttctctgtaaagtacccagtctgtaatattctgtaatagcagcacaaaatggaccaagacattttgctttctcctcaggccgatcccaagacacaaaaaatgtcctgctaattagtgaaggagttcactggcacagacccaatctgcagacaaagaaatggctgccttttcaaatgcctactttccaacaacaaaaatcacaaattgtatttaaaaaaacaaggccgggtgcggtggctcacgcctgtggtcccagcactttgggaggctgaggcaggtggatcacgaggtcaggagatcaagaccaccctggctaacacggtgaaacccttctctactacaaatacaaaatattagccgggcgtggtggcggacttctgtagtcccagctactctggaggctgaggcaggagaatggcatgaacccgggaggtggagcttgcagtgagccgagatagcgccactgcagtctggcctgggcaaaagagcaagactccgtctcaaaaa

SEQ ID NO: 20840 - DNA, 604 bp, Homo sapiens
gagtgagttaggttgtggagagtgtcaaataccaggctcaggtgttagaaatgcattgaatcatcagtgcagggtattcacatataacatggctggaacagtgttcagggcggtgtctgtaccgtatagagtggattaaaggacaaaagagatgaaagaatacaggtgacccatgaatttagcaaaatgtaataatctgtgaaagtatgattgaaaatagggcaagggatgacatcgccaagggaggtcttttggaaaataaacgggattgtgaaataccaacgttttggaatggggaagaaaaggagttcgagaagaggagctacttagggagcgcccagatggttcaaacatcataaaaacaacagtgtttcaggagacggaacactgttgctttgctgcagagagccgaaagagggtgagaactaagctgatggtggaatttgggggaatgacagaggagggcaagagagagagatgttacctgtggactgtcctttcgagtggttcagaagagttggtaagactaaaaatagacaataatctcttttgagaattgtgatactgcaagaaaagaaaaagaatattggttgaactaagcaac

SEQ ID NO: 20841 - DNA, 2299 bp, Homo sapiens
  misc_feature (1883)..(1883): n is a, c, g, or t
ctaaacagtggagaggagtgcaggaggcccatcagctgtgcctttcccagaagtagcaggatctgagcaagtgtctgttggttgaagaggcacacatgtcaggctggcaaccagcagcatcaggaaataacctaagacgcggtgtgtttatcattcccctgctgggagcctttggcttggtccgtccgcataacacggggttctttgggtaggcggctagaagccgagcggccgggtcgcagcatcgtctcctttactgcattgtactccacagtcgtaatgggaggttcccgcttcccacatcctttccctcagccgttacatcttggagcctggatgcattatgaaggtatttttgtttcgtggcaacaatttttttaaaattttgttttggtgcttctttgacaacgcggcccacgcagctgccctctgtgcagccattaccccaccaggcctgacacagcttctctctctgggcctgggtatgagggcacagtccaaagtaacactgactttctctctctttccccttctgtttctttgaccatctctctttaggcctaccagttttggcaacagaagttaccggtcaataatcagcaagttaaaaagtatcggatgcgatttcaattatcagacttggtagctgcctcctaggctgtgggtatcctcaatgatctgaattacttctgtcatcttgaggagtgagagtggaaggaaatgtttggtgtgggttcctgggccaggaggttttctccctggggttcccattccagaacgctgtcctcattcatggttgctgttcacctttcaccactccctgcattatttcatgtgggcgaggaacgagtgtggaaatggggattggggactaatagacttgtctcttcaccaggtctccccacacttccagtccagaaaacactttttagttatagaaatggatatatcggctgggtgcagtggctcatgcctataatcccagcactttaggaggccgaggcaggcagatcacgaggtcaggagttcgagaccagcctggccaacatggtgaaaccccatctctactaaaaatacaaaaattagctgggcgtggtggcaggcacctgtaatcccagctactcgggaggctgaagcaggagaatctcttgaaatcggaaggcggaggttgcagtgtgctgagatcacgccactgcactcgagcctgggcgatgagagtgaaactccgtctcaaaaaagaaaaaaaaaaaaaaaacgcatgaatccgtggaccacttaggcccaagccacatttgattgcagtcttgtgtggcagaaggaacctgtgtcccatttggcacttttggttgcaaacacagagacttggggctttgcaaggaaagggggttactgtttagatgtcaaggaaagaacgcttatctgcggcggtcggatgttggcccttcagctgttcggtcccttaagtgtttgcaccaaaactaggacacctagtgaggtggctgcgaagctgctgaagccccaccgccgtatgttcctgccagggaggcttttgggtgttcatctgacccaggtctctcttctcactgctgcagagcctgagcttccaggaccgttgcgggcgccctgtctgcagggggctagccaggtttcctcacatcgtgggggccccaggtgtcccttcagcttcccagaggtttgctgggggaacaggatgtagcgcctaccccaccctgggcatctgccatcaggtttcttcctctccttgagttcacttctgccactcccagtcctggccacacactgaagctccctgtcacccgccctgcctgtgacaacctcccgcgctaccacacacccttactcccgttctccctcttcgcacncccaggactcacccaagcccagggttgcccctgctaccccctcactgcccccggcccctcctgaatgccaggtccccctgtcctcctgctccgcgtcacctcagccttgaagccacagtcttcctgcatcacaccaagcccgcccctccccattgttccctataggccttggtgacacggacatccacccagtctcctgcagccatggctgaaccacgtccctcttcctcagcccgtgcagagcgtcctgtaggccttactttgtgcctctcacccccagccccaccccgcctcttgctctcgtgcctgggctttgtggtggctgacctcttcactcccgatcctctccccttcctgtccatccttctattcccctgcagcctgggtgacagagcgagacttcatctcaaaaaatc

SEQ ID NO: 20842 - DNA, 491 bp, Homo sapiens
actctatgaaggcaaaactaagagcatgataaaaagatggctgcttttgtaccagctctggaaacctgttttttcctcgaaagagaaaaaaaattatccttttaataagtcattgttattttggattttctgtcactaacagacctaatcctattataatttgcctaagatccaataaagatttcactagtatgtcaggtgtggtgcttcgtgcctgcaattccagcatgctgggaagccaaggcaggaggatcacttgagcccaggagttcgagacaagcctgggcaacatagcaagagctccatctccataaaaaaaataaaaaattagccaggcatagtgggtagtgtgtgtctgtagttccagctacttaggaggctgaggtgggagtatcacttgagcctgggaagttgaggctgcagtagtgagctgagatgatgccattgcactccagcctggtgacagagcaaaaccctgtcttgaaaaaaaa

SEQ ID NO: 20843 - DNA, 215 bp, Homo sapiens
tggggaaaacatttcccttcatctgtttattgcaatcaaataatgtgaaatgaaggtaatgaaaacactctgccaggtggcttcctgtatctgcagccaaaatatatgaaagagagactgtcccttgaatatttttgaggagcaaaggaggacaaagaatggagtttttgcctgggtaggataaatacatgtgcaaatcaagccaatctttagaa

SEQ ID NO: 20844 - DNA, 477 bp, Homo sapiens
ttccggtcccagggagccaaatgtcagggagatgtgctcaggctcggtccccctcttgctccatccctccccaagaaacgccgtgtgctgactgcctcccttgagcaagtatgtttcccagggcgtgggtaaaaagtgccgagagcaggctatttggagacgcgtggaaagagaaggacacatttcttgcgtcttctgcacaagccagtgaggagggtgagcagagcagccttgttttttgctggcaaaagtgacactagatggaggcttgatgaatggtgccacattcacgggatgttggtccagcattttgacatatgctagtcttttgtgcagttgctgaaaatcaagaaattcattcttttttctttttcttgtggcagctgataatttgcttgggtgttgaatagccagcctgagctattttactgtaatgaaatcccagaccacacaaaattaagtcacttcaaagtaaaa

SEQ ID NO: 20845 - DNA, 351 bp, Homo sapiens
atgcagccgcgtcgacaggactcacttccttcttgggggttctactcagtggttgtattttttcgaagcatttgtttcttactctgacgataattgcacataggagaatagttaatgattaacaacactttaaagtgggataatcggcagtgtcttgttttctatcttgttttaaggggttggtaatatcataattaataacttacagaatggtaataatgtcttaaaatagctttcccatagtactataatcccagagctttgggaggaagagataggaagatcccttgaggccagcaattcaagaccagcctgggtaacagggcaagactccatctctacaaaaagatt

SEQ ID NO: 20846 - DNA, 347 bp, Homo sapiens
attgccattgtggtatagtattctattgtttacctaaatcacaatttatttattctgctactaacagtgagtaatcatacttgtaaatacaaaatatgtttatatgtttttacacataatatactttatgtaagtcctatagtgtcccaagaaacaagttttggaggcaaaatgtatccttgaattaacaatttctacacttgattctgtgtagtattagtgttgctgagcaattcaaattttacattattttaatgttatccaataacattcacagatattttccagtgtttgaatatttgctgtagggtacagttgtgtacaaatacttaaaatgcaaaaaaaaa

SEQ ID NO: 20847 - DNA, 607 bp, Homo sapiens
tggttctttctgatatatgcctaggattggaattgctgggtcttatggtaattccatgtttaactttttgaggaactcacaaactgttttctactgtatacttaccatttcatatcccacttgcaatgtacaagagttataatttatccacatccttgccagcgctttttattttctttttttttaattgtagccatgccaatgtatgtgaaataatatctcactgtggtaaaatgagttttatatgtagcttttctgcctgtaacttactctgtatgttaaaaggaggcacaatgatcaatgtgttaaaatctattaatatctgaaaaatgggctgggcacagtgactcacacctgtaatcccagcactttgggaggccaaagtgggcacatcaacttgaggccaggagttcaagaccgatctggttaacatggtgaaaccccatctctactaaaaatacaaaaaattatccaggtgtggtgctacaaacctataatcccagcaactcaggaggctgaggcacaagaattgcttgagtctgggatgtggagtttgcagtgagctgagattgcaccactgagctccagcctgggcgacagagcaaga

SEQ ID NO: 20848 - DNA, 649 bp, Homo sapiens
aacctatgaacaatttcgtcataaaattagtaattttattccagtctgaaatttaaaaacacagaaataccttggtagcatgatgaatccattgccttgatctttaacgtaagtgtgttcttgtttgttctcctagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataaaaaaaaaaaa

SEQ ID NO: 20849 - DNA, 2029 bp, Homo sapiens
cgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataaaaaaaaaaaa

SEQ ID NO: 20850 - DNA, 309 bp, Homo sapiens
catcaagtttcattatccctatttctcaggtgaggaaactgaggaaaagaaatcttttgcagcttgcagcagctcaaagcatagctgtaaagtgttggccgtgagcacttagtcactgtactatactgttctttatggtcaagtatctgtagcaggagctgagatgcagtggtaggaggtaccagggcccttacctcaaagagctcagagtctcatatactagccagttaaccaaataactgattcagactacaatttgtcctgtaatcaaactataaataatgagttttaggaagaatgaaaagagac

SEQ ID NO: 20851 - DNA, 373 bp, Homo sapiens
gctatacacctaacattttagttaagataaattccacatttttaccaatacttctcccctatgtaatgtcaaacacaataccttcctcctcatagcagttatgcagtagatgagttgtataaatacaagagttatataaataaaaataaaaccacagttttactgtatcttcggaaaactcacattttggtatgcaagtcaagatatgcacatttgaaaaaaattatgccaattaacggtaataaaaatatatcagagttggccaggcatggtggcccatgccagcactttgggaggctgaggtggacgcattgcttgagctcaggagtttgagatcagcttggacaacatggcaagacttcatctctactaa

SEQ ID NO: 20852 - DNA, 378 bp, Homo sapiens
aaagagcctaagcttgaaacactctgtgacttagtttttgcatttattctgtcttctatgccccccaaccttactccaaattaatgaggcattattttatttatttatttttttgagacagagtcttgctctgtcgtccaggctggagtgcagtggcacaatcttggctcactgctacctccgcctccagggttcaagcaattattccgcctcagcctctcgagtagctgagactacaggcgcgtgctaccacacccagctagtttttttttattttcaatagagaccgggtttcaccatattggccaggctggactcaaactcctgacttcgtaatccacctgcctcagcctcccaaagtgctaggattacaggcgt

SEQ ID NO: 20853 - DNA, 313 bp, Homo sapiens
actaatgtggagcacagggaggtaaattatactgcccacattcacaaagctgattgatggcaaagctgagatttgaaaccaatcagttttgtttcagaatggcctgcctaaccattttgcgtactgcttccctaattttgacacgtaacattggctgggacttagataggaggacaatatgtctgcaacatctgtcacttcagtgatccctgtgatcacctggttagtcagaacatgatgtcttcttgatccatcacagctccatgtctgtctctctaaccttgggcttaaaaaacaaatgccctttccagac

SEQ ID NO: 20854 - DNA, 326 bp, Homo sapiens
tttagaaaatgtgtatattaaattaaaagaatattttgaaggctgggcgcagtggctcgcgcctatagtccctcggcctttgggaggtcgaggcagatggatggattgcttgagcccatgagttagagaccagccagggcaatgtggtgaaatcctgtctttacaagaaatataaaaattagctggtgtggtggcacatgcttgtagttccagctactcgggaggctaaaatggaaggattgcctgggaggcggaggctgcagtgagctgagggcgccactgccctccagcctgagcaacaaagtgagaccctcaaaaaaaaaaaa

SEQ ID NO: 20855 - DNA, 227 bp, Homo sapiens
gataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaatta

SEQ ID NO: 20856 - DNA, 349 bp, Homo sapiens
tctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaacaggtctgcttggcagctgggataggacccccggtccatgcatcgtttttctgtgatgatctctgcattgaggagtt

SEQ ID NO: 20857 - DNA, 363 bp, Homo sapiens
tatgaacagcaaaatcatcatgggtgcttttgtaggaatgtggattaaggaagtcaaaatcctcccaaaagggattttagctttaactgtgatggcttacatacatacctacatttttataaagaagaatgtgtacatatattatttgtgttgttcttaactatacagggaaaaagactgaccaaacattaacatttgttatttctgtgaaaatggatgattggggccaggcacaatggctcatgcctgtaatcccagcactttgagaggccaaggcgggtggatcacttgaggtcaggagttcaagaccagcctggccaatgtggcgaaaccttgtctggactaaaaatacaataattagcc

SEQ ID NO: 20858 - DNA, 1124 bp, Homo sapiens
gatgttaaagaggttctaaatcttggtggaagttattataaagttataacattgtttcctaagtaatggaagaaagacccaaaatttaatgagagtaataaatgtaaaattaactaaagctcagaaatgaagataaaatatttcaacatatctcattaatattaattttagaataactgatatgaacttaagatacttttaagaaggatctgatcagcagatagtataaaatgaaattcaagaagactgtggtggtgttggcttcacggtgtatagttatccccaaactcgttgagttgtatacattaaatatgtatagcgttttacatgtcaatcagacctcaataaagtggtttaaaaaattcagaaagactagattttcttaagagaaaaaaaagttatgaagactgatataaattatgttaaaacctcatgtacctaatgttatttccattttgagacatggatgagaataagaaggtaatttacaaaatgctttttagccaactagaattgatagactaaaatctgtgggtttaatggatttccttataggctcttatcatggataaatttaccctgctttacatacttctcttataaactggaatacttggtttctaaatccgtatgttagcagtgtaataatagagttggacagaaacagacccaggacaatagacaaagcctaacaatgtggaagcaagcagtaaaatgctgaaaagcgaatacaacctggaaatcaagttatctggagctttttatgggaaaacagaaagtctttaaattttcttaggtattccctaatcactttttctcatttataaaataatcagttaacttggctgggcaaggggctcaggcctataatgccaacactttgggaggccaaggcgggagaattgcatgagcccaggagtttgagaccagtatgtataacataccaagaccccatctcttataaaaataaaaaaaattagtcaggtgtggtggtacacacctgcagtcgcagctgaggtgggagagtcgtttgagcctgggcggttgaggctgcagtgagccaagatcatgccactgcactccagtctggacaacagagtgagaccctgtctcagacaaaaaaa

SEQ ID NO: 20859 - DNA, 346 bp, Homo sapiens
cagatactaacatgtactagcatataactggataatatatttaaaaatatactctgtggttttcatcagttcccattcaaaattgtaatattgtgaatacacgttgctttttaaaattttccttctcaaaatttattttatttatttttttgtgacggagtcttgctctgttgcccacactggagtgcagtgatgctatctcggctcaccacaacctctgcctccacctccagggttcaagcaatttttctgcctcagcctcctgagtagctggaattacaggtgcatgtcaccacacccggctactttttgtatttttaggagagatgggtttttgccatgttgg

SEQ ID NO: 20860 - DNA, 386 bp, Homo sapiens
agtatggctgaaaccaggtaaataggcatatatttaaatggttttaatcctttaggctccccttcctatttttcccccagtagtgataaagagatatttcctatctccttacccaaataaaaaacaagcctaatcctatacaaattaagaatatagtatcctacttgtatttcaacactatttattgccctgcaatttcctagtacagaactcagaacagtatacaaatccatagacagcattcttcttaactgttgtctaaattatataacatatatctttgcctccattctgtgttatgagtcaaacttatcatggctggatgtctgaataccaccttaatttgtataaatagatctaagtaaagaaattgtctaattattaca

SEQ ID NO: 20861 - DNA, 154 bp, Homo sapiens
gtgaacaccaaatttccgtatcctcaagatcagaaatagcacgacaataaaaagagggaggaagaaaaaaaacagtctaggatgtcaacaattttttttctgaagatttattttcttctctttgcttgttcatattttctttccttccttcctt

SEQ ID NO: 20862 - DNA, 652 bp, Homo sapiens
aagcaaggctgtcaatgaaaattgatccaaaccattccatccaacttctttatacgcactaaaacccaagtgctcatcctgaagaaatattttggttcttatctatttgtgatctatttttttctgtattatcaggtgatactcctcctccttgctgtgaaaaaaactccagtacttaaaaaaatataaaattcattatatcctccataccactagaggcctgctatgaatttctaagaattcatttaaatagcctatacgttaccagatttttttttttatgtatataacagagaaaaacaaaatgcattaaaattagcttcatcttgacacttagttcagatgagctggtcatacataaatggaaattgttagtagttcaaagatgttgtagttaacttctttaaagaaacagattgagaagcttttgttgtagttaacttctttaaagacacagattgagaagctttccgatatcaaaatgtattcattactttgaatgagagttctttatttgttcatttgcttatatgcgctctttcatctgggaattttttcttttatacgccacgtcatacagatcccctctaatgcagtttctggttatattggtatagataatttattcttaagaatctagcagtatttggca

SEQ ID NO: 20863 - DNA, 4174 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgcttacagacatctcctcaaataggaagcccaaatgcctaagccgagggcacccgcattcggtatgtaaccaccctgatctcaagtcccatttccacccaaagggaaggaaccacctgaaaaaggccaaggatgacagagccagcatgcagcctgccaaggccattcacgaacaggctgagtcctcaagagacctctgcagacctccaaagaaaggggagctcctggggtttggccgcaaaggcaacatcaggcccaaaatggctaaaaaaaagccaacagccattgtgaacatcatctaaaagggtgggtggtgctggaccaatcatcgctgggctttggggaacgttgttccaggagccaacagtaatgtctttctggaaacattccatagtaagacacattggaaaagccaagggcataacacaggcaagcacctcaattaaccagagcttagcaaatgggaatcttagtgaaccagaattttattataacccccttttagaagcttgcaaattacagaaagaataaaaaaattaaatcaatcttaaagctctaacttctaaagtaactggcccagtctccagtaatcttggcatctgggcttctatgcagtggtcactaattttcaggaccaaggccacacaaaatgtcaggcctagggagaaaattcatctgtgcccactgctctccaaagtgcgaggcaaggaatggcagtgtaaagttctgttaatagcagtaaaatgaaaatatttgtgtttgtgtataaccttcccctcagctaatttgaaagcctccaaaataaggattcccattccccgagtattctggttaatcaagatttcaatttctgggttgctcaagggactcgttcagtcagacttcagttctcattccgacagggtgtctttcagttcgtttgtttgattgaggttttttggtggcctagatgcatgtttattcagattttggtacacctctgccgtcttctttggctgagtattctgcacccacagaccatgctgccagcctctatcttaatagctgcttctgtggatatggctggggagcgaagtaaaatcctcttttgattagcacccagcatgggctgggtggctaggtggttggaatgacagtggactgcacgcttggtgcatcgtgcatcgtgaccatcctggaagcactgcgggtgtcgccaagccctttcctaagacctgcttcccggccagtgtcagtggccctctctctctctgctatgggcatgactttctcttcgctggcttaacttttccactgggtggttcactttgcctcctgctgcttctgtgccctgttaaggcttcaggtatctttcaaccaagtatctggagtgttcactctatgttgcattctaaagtaatttctgaaataaacaatgcatgtaggagccagaatctgacactgtcttcccctccttccctccctaaaatggctttagtttccacaaagagctgttaagaatttcctgctgtatgattttcctcaagaatgaatttccatgttattttttccttaaatttagcaatatcatcaggtctcttgcagagtttacaagtgctgacattcttctgaaaacaggaataattttgtccacaaatatatacatatatacatatatataacacatacaaaatatatatgttaagtatattaataatttatttttaaatactcatggagaaagtgtgtgtttgtggtgggtggtttttaaactatatatgtttgttcatgtaaactgaattctcttatttaaaaaatcaaaactgtaacgtaattaacattggcagaattatgattgttactgcaataagcatcaaattagcagcgcattaaaaataggaaataaagcagttgcttaaaatgccagtcaattgaaaagtgtaacttatcattatacaaacattctgaacctaccataatgaaaatgttcttgaatcttcactttgactttcagtttatgggggggtagatcattcatgtgatatataagcagctatcaagtgggcaaaaacattgctgtgaatagcactgtttaggctaacattgtaaaaattgtaatgttataattattatttatttggagaattaacttccccctctaaagttatttattattgatgcttataccatgattgcaccttagccttttacatactaaaaacatgacttgttagttgtattgcatgctctttgtcctgtaatgtgtgtgcaatgacaacttgtttctgttttatttaaagtaactgacattttggattttcatctaacatagagggcatggcaactctctttgacagtggtaccccatgatcttcagaaagtaccataatgtcatcctactctacatttcacaagacgaattattttgagatttgtttattatattaaaatgtttttttacgttcccactaaattttgaccccatataaagaaatgtgttatgtatgttgtgcctccttagagacataaatttagtgtcaaaacatgggagatggcttactcagaagcatactccacttaacataccatggcctgagctaagtaccatgtcctgtttgtgtcttatttttaaatattttctttgtccacatgggccgttgaccttagagttaaggcggttgcttttttgaagaaatcaccaaagtttctgggaaactatgttcaaggttgaaatggagagtagatttaattttatttgtcttgtagggaagaaatcttcctttgaaccgcttttcttgctttttccctttttcccaaactaggttacaggttcttatctgcaaggttcaagttgcttagacattgttttccagtattctgcagggccagtcagttgtacagaagttggaatattctgttccagaattaaagaagtttttagattatgaaatattatgataataaagctatatttctgactaatgtgttgatatgtt

SEQ ID NO: 20864 - DNA, 3418 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcaacaagtcggagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgcttacagacatctcctcaaataggaagcccaaatgcctaagccgagggcacccgcattcggtatgtaaccaccctgatctcaagtcccatttccacccaaagggaaggaaccacctgaaaaaggccaaggatgacagagccagcatgcagcctgccaaggccattcacgaacaggctgagtcctcaagagacctctgcagacctccaaagaaaggggagctcctggggtttggccgcaaaggcaacatcaggcccaaaatggctaaaaaaaagccaacagccattgtgaacatcatctaaaagggtgggtggtgctggaccaatcatcgctgggctttggggaacgttgttccaggagccaacagtaatgtctttctggaaacattccatagtaagacacattggaaaagccaagggcataacacaggcaagcacctcaattaaccagagcttagcaaatgggaatcttagtgaaccagaattttattataacccccttttagaagcttgcaaattacagaaagaataaaaaaattaaatcaatcttaaagctctaacttctaaagtaactggcccagtctccagtaatcttggcatctgggcttctatgcagtggtcactaattttcaggaccaaggccacacaaaatgtcaggcctagggagaaaattcatctgtgcccactgctctccaaagtgcgaggcaaggaatggcagtgtaaagttctgttaatagcagtaaaatgaaaatatttgtgtttgtgtataaccttcccctcagctaatttgaaagcctccaaaataaggattcccattccccgagtattctggttaatcaagatttcaatttctgggttgctcaagggactcgttcagtcagacttcagttctcattccgacagggtgtctttcagttcgtttgtttgattgaggttttttggtggcctagatgcatgtttattcagattttggtacacctctgccgtcttctttggctgagtattctgcacccacagaccatgctgccagcctctatcttaatagctgcttctgtggatatggctggggagcgaagtaaaatcctcttttgattagcacccagcatgggctgggtggctaggtggttggaatgacagtggactgcacgcttggtgcatcgtgcatcgtgaccatcctggaagcactgcgggtgtcgccaagccctttcctaagacctgcttcccggccagtgtcagtggccctctctctctctgctatgggcatgactttctcttcgctggcttaacttttccactgggtggttcactttgcctcctgctgcttctgtgccctgttaaggcttcaggtatctttcaaccaagtatctggagtgttcactctatgttgcattctaaagtaatttctgaaataaacaatgcatgtaggagccagaatctgacactgtcttcccctccttccctccctaaaatggctttagtttccacaaagagctgttaagaatttcctgctgtatgattttcctcaagaatgaatttccatgttattttttccttaaatttagcaatatcatcaggtctcttgcagagtttacaagtgctgacattcttctgaaaacaggaataattttgtccacaaatatatacatatatacatatatataacacatacaaaatatatatgttaagtatattaataatttatttttaaatactcatggagaaagtgtgtgtttgtggtgggtggtttttaaactatatatgtttgttcatgtaaactgaattctcttatttaaaaaatcaaaactgtaacgtaattaacattggcagaattatgattgttactgcaataagcatcaaattagcagcgcattaaaaataggaaataaagcagttgcttaaaatgccagtcaattgaaaagtgtaacttatcattatacaaacattctgaacctaccataatgaaaatgttcttgaatcttcactttgactttcagtttatgggggggtagatcattcatgtgatatataagcagctatcaagtgggcaaaaacattgctgtgaatagcactgtttaggctaacattgtaaaaattgtaatgttataattattatttatttggagaattaacttccccctctaaagttatttattattgatgcttataccatgattgcaccttagccttttacatactaaaaacatgacttgttagttgtattgcatgctctttgtcctgtaatgtgtgtgcaatgacaacttgtttctgttttatttaaagtaactgacattttggattttcatctaacatagagggcatggcaactctctttgacagtggtaccccatgatcttcagaaagtaccataatgtcatcctactctacatttcacaagacgaattattttgagatttgtttattatattaaaatgtttttttacgttcccactaaattttgaccccatataaagaaatgtgttatgtatgttgtgcctccttagagacataaatttagtgtcaaaacatgggagatggcttactcagaagcatactccacttaacataccatggcctgagctaagtaccatgtcctgtttgtgtcttatttttaaatattttctttgtccacatgggccgttgaccttagagttaaggcggttgcttttttgaagaaatcaccaaagtttctgggaaactatgttcaaggttgaaatggagagtagatttaattttatttgtcttgtagggaagaaatcttcctttgaaccgcttttcttgctttttccctttttcccaaactaggttacaggttcttatctgcaaggttcaagttgcttagacattgttttccagtattctgcagggccagtcagttgtacagaagttggaatattctgttccagaattaaagaagtttttagattatgaaatattatgataataaagctatatttctgactaatgtgttgatatgtt

SEQ ID NO: 20865 - DNA, 1435 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgcttacagacatctcctcaaataggaagcccaaatgcctaagccgagggcacccgcattcggttacaggttcttatctgcaaggttcaagttgcttagacattgttttccagtattctgcagggccagtcagttgtacagaagttggaatattctgttccagaattaaagaagtttttagattatgaaatattatgataataaagctatatttctgactaatgtgttgatatgtt

SEQ ID NO: 20866 - DNA, 505 bp, Homo sapiens
ccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagca

SEQ ID NO: 20867 - DNA, 455 bp, Homo sapiens
gcatactactactactactactaaattcgcggccggtcgaactaaatggggcaatgtgtataaatcggcacttagtagataatcaatttatgtaatttactgtagctttcattcttgaatatatgtaaaaacatgtaaagacttatcaacattgcattgatttttcatataaagatattatctttaggcagggtgtagtggctcatgcctatagtcccagcgtgttggaaggccaagtggggaagatctcttgaacctaggggttccagactagcctggacaacatggcaaaaccctgtctctataaaaaaatacagaaattagtggggcatggtggcatgcacctgtagtcccagctactcgagaggattgcttgagccaggaggttgaggctgcactgagacaaaatcacacccctatataccagcttgggcaagagtgtgagactgtctcaa

SEQ ID NO: 20868 - DNA, 320 bp, Homo sapiens
gcatactactactactactactaaattcgcggccggtcgaactaaatggggcaatgtgtataaatcggcacttagtagataatcaatttatgtaatttactgtagctttcattcttgaatatatgtaaaaacatgtaaagacttatcaacattgcattgatttttcatataaagatattatctttaggcagggtgtagtggctcatgcctatagtcccagcctactcgagaggattgcttgagccaggaggttgaggctgcactgagacaaaatcacacccctatataccagcttgggcaagagtgtgagactgtctcaa

SEQ ID NO: 20869 - DNA, 724 bp, Homo sapiens
tcatgttcttctctaatttaacctgcattcttaaaaattggttatctgccacgtaagattcacaaaaggcaaacctgaagtgtctgtgactgtgtgtgtgcatatctgggggtgtctgcagatgtctgatgtgtatcctgggggtgtgtgtgtgcatgcatgtctgtgtgtctgtctgcccatgcacacatacacttgcccaggagactaagggatgctgaccaggagaaggcagccaccaagctggaggtgaagtcaggtgggacaggagctgggacatctaaaccctagatctggcccctgtccccatgtccatagtaacccccctcaccccactctcccttcctcaaagtggatcaggggctatttacaaaactccctccccctgtctctctggggtatatgtatgtgcagtttccctcttgctgaaatgcccttcatttcctctctcctccctggaaaatgcctgtctatccttgtgtgagggttcagaggctcagaaaccccttctctgggagggactctcctatctgccaccccttaaccagctcccactgtgcctcttccctcatctggcacattaaattattacttgcaaaataggcacagtggttcatgcctgtagtctcagaactttgggaggccaaggtgggagaactgcttgagggtcagaagttcaagaccaccctgggcaatgtagtgagacccccatctctacaaaaaa

SEQ ID NO: 20870 - DNA, 455 bp, Homo sapiens
gaagatggtgataaggttctgatagtgaaggcaaattaacatatccatcatcttacatggttacacattctttttttgtggggcaagagcacctaaaatctactcttaaagcaaaaatcccaagtacagcacagcacggtattattaagcatatcccttatggtgtacgttagatctctagacttgttcaccctgcatatttgctactttatattctttgacctacatctccccatttccccattgagtctttgtttgtttgtttgttatagattttacatataagtgagatcatgcagtatttgtctttctgtgtgtggcttatttcacttagcataacgtcctccagattcatccataatgtggcaattggcagaatctctttttgaaagctaaatgggccgggcatggtggctacgcttgtaatcccaacactttgtgaggccacggtaggt

SEQ ID NO: 20871 - DNA, 508 bp, Homo sapiens
gatgtaaattccctccccgtacgcccaatctccttcttcctcttccttttcttcagaccatttgcctgcccctggttcttttattctcaacctaacacgcactgtcatgcatattcaccagcattctccaaagaccttgccccctggttatcccacactacctttctaagcctatcctcacgcaacctcagacaaaccccaaccccaactaactgtgttcttcaccttcccttgctggggaaaaaaaacccctgcacagccacagatcactgcaattacatataacgcatctcctctctcagtgaagctcttagggctggcagccggttctctttgcagtctttctttttttttttggagggtgggtggcgctgttccacatgttttatcttacttcaagttctttttcccactcagacttcacctcctattcctactttacagaaacagtgaatgcttcccaggagaactccctcaaacacccttccctccaaaaccatatttactt

SEQ ID NO: 20872 - DNA, 220 bp, Homo sapiens
acgatttcttactaaacgactggagacaccagacaatgccctcactgttgtgtggctgcctgggagcgttcccgcagcatcagagtctctgtgctcaggtgacccttgtgctgggggtaggatgcccccccacgtaggccttaaacatctggatcacgctggggaacctgccacagggatctttaaaaaaaataaagtaagggtctggattttgaacaaa

SEQ ID NO: 20873 - DNA, 1333 bp, Homo sapiens
  misc_feature (802)..(802): n is a, c, g, or t
atgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggagattggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtgggtcacggagtggccagggaggctccgtctgagccacagggatgggtgtgcagagctccctcctcctggggtgccagggcagagattccaggcaggtgagcccgacagagagctgccaggccacaccccctcggcctcctgcacggccaccttctgggtgaatcggtccagcccaagcccctctccccagcctccccttcagcctctctcccggcctgcttttataaggcgcacttcactcaatgctgnagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaaaaaaaaaa

SEQ ID NO: 20874 - DNA, 874 bp, Homo sapiens
aagagcaagagcattggagtcaaaactgggatcaaattccagctgtctggtgttcttgctgtgtgatcttgggtaaatgacctcccctcccaggacctcagcttataaaatgaagcatgccaccctatctccctgggctgttgtgagaatgaccttaaaggagaaactatatgtgaagtgctgttctggagtaatgaccgcagacacaggtatcactactatgttatttatttatttatttatttagcggcagggtcccgctccgtcacctaggctagagtgcagtgatgagatcacggctcactgcagcctcaacctcccaggctgaagcaatcctcccacttcagtctccctagtagctggcactacaggcatgtgccaccaaaccaggctaattttcttttttttatttttgtagagatggggtcttgctctgttgcccaggcaggtctccagcttctgggctcaagggatcctcccgactgggcctccgaaagtgctgggatcacaggcatgagccaccatgcctggcctaccatgtaatttaaaagatctgagcaggtagagttcaaaagtaaattctagaacagcattttgtaacagaaatctctgttatgatggcaatgttctatagctgtgctgtcgaatatggcagtcaccagccatatgtggctactgagcacttgaactatggccagtgtgcccgaggaactaaatttgaaatgaaaatttattctttctttctttttttttttgagatggagtctcattctgacatccaggctggagtgcagcggtgtgatctaagctcactgcaaactccacttcccgggctcaagcaatctacctgctttaaggaggattgaagcagaag

SEQ ID NO: 20875 - DNA, 576 bp, Homo sapiens
tatttgcataaacatcatgagatatattcaggatggaacccaagtgtaaacacaaaatttatttatgttttatatatatcttatacacaaagcctgaaggtaattttatgtaatattttaaattttgtgcatgaagcaaagtttcgactgcattttgactataatctgcattttagtggaaacatgctgactctcagaaagtttcagattttggaggtttctgaatttcagattttaagattagagatgctcaacgtgtatagtagaataccacagagattggttaacttataaagaagatatatttatctgtctcatggttctaaaagttgggcagtccaaaatcgaggggctgcatctggtgagagccttctcattgcataataacatggcaggagatatcacaaagcgaggaagcagtgggagagacagagagagagtagtggatgaactcattctttttatcaggaacctactccaaagatagctaaccactcctatgataaggtcattaatccactcatgagggcagagcccccgtgacctaatcactttttaaggatgtctacctttcag

SEQ ID NO: 20876 - DNA, 510 bp, Homo sapiens
caaaacacttcaccgtgactgattatgtcctagtgaggtagcaatgcgcttgaattatgaatttatccaggatccactgtgggagttagtgtggcaacctagaaatagtatgagcttgaggccagaaaggctgggttcaaatcctagttctgccactcactgtgtatccttggacagctaatttaacttttttgaatgctacgtcctttagctaaaataagaatatcacctagataaccagttttgttacaagaagcttgggacatgaaatggtaagtgaatgatccatcacctggtctatagtagctgctcaataaagaccatttttcttctcaacatttcacatcctagaatgccaactcactatgagaagcaggagttgactctttgatttaagcttcattttcacactcttctcagtgtccccttactcagacgtaccattgttattccctccttatcacctcttcacaccctaggtctgtgaagtgcttgtgccaagcacttgct

SEQ ID NO: 20877 - DNA, 964 bp, Homo sapiens
ctgtccccctcccgcgtccccgtcttcttgatgactccaacagctgcagctgcagaggccccgaggcccctcggaggagactgggcagggagggctcctccgcatgctgggatatttttatcctgccttggacgatcgggacgattggtcctgcaatctgtttcaccctttaagaaactcatttcatgtcctgccaggtcctgggaccataagctcgcgtgtctccacagttgcacattcccgtccgtctgcagctcattatctgggccacaaggacgttaccccatgacttggaaggacgcgccatcacgcaggaggtcacaaagtggacggcaggaaacccagccttccctcttctgccttcctcctcacctctctctctctctctcagtactttgttcttgttaatatcagtgtatcaatgagcctggttttttgccttttattattattattaacatagtgagcacaggcgtttcgtactctgcgtctgattttccagcagcgaagcctctgccatccgccccaccgtcccgctggctcttgctcattgtctttcccttccctgcttgcctgctccctcacgcccctgctctgcgtgttggatgtgaaaaggatgtcagggactaggcggagggcatgttcctccgagcccaggctgcaccttggcacagtggagggtccacccaccccaggtagcccaggtgaggcccctgggtccccctgtcactcaggctgtccacatgaaagtccagatgtctccgaccaacagatccctgggagaaaggacgtgacgctgccgcttcaccgggatgggttcccacgtccctccgcgttgacccacagcttccttacggtcttgtatgtagtttgatgcttttaagggccggccacggtggctcaacgcctgtaatcccagcactttgggaggccaaggtgggcggatcatgaggtcaggaattcg

SEQ ID NO: 20878 - DNA, 614 bp, Homo sapiens
ctaaagcacagagcgcagtgcttgtcacgtactgagctttcagacattgtctatgactattacttaattcttgaaaaattcttggttatttattgcttgaatttacaattccatttttctctccacctaagcaatttttattttaggcttcagagaatcagcagagaataaatgcatgactcctggccattaatagagcaggaaagctcactccaggttcagaagtcacctcactgctgccccctctagccggctgctgacaccctgctggtggtcagagacatttcagggcaacacaggcaggtagtgaatcctaatgcagtagtcaggaaagcctgactttacagtaggcatttggaaagatttggttataaagcagcttatcgctaaatcaagccaggagggaggtacaggatatttcattccccatcacatgtaaaaattaaatctgtctctgtagaagcagcgctccctggaaacatgctaatggttgagaagtaatcttgaaccaactactgccttggctacggtaaagacaggagcctaggtactcaatacatttctgttaattaaattaattaaacctcatcattttaaaataaaggtcattgaat

SEQ ID NO: 20879 - DNA, 232 bp, Homo sapiens
tgcaaatgtttgctgattcctgcattactgatatcattttcataacagtcttaaaaacttggcatttttaaacttaaatacttttttctttttgtcgctttcttctctaccctatctctgccagcagttctttgtgaattaccattgtgatcttctaaaggcaaaaaaaatggtaggtagtcaatgactgatagctatagacctatgaaactaacatttcctatcttgtctc

SEQ ID NO: 20880 - DNA, 732 bp, Homo sapiens
gagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttg

SEQ ID NO: 20881 - DNA, 287 bp, Homo sapiens
agcaacattataaaaatattgcctaacacaactccatatggacatatgaaatttcattccattttatacatgtaattaagtggcccacataatgaagtactgtgagtgcaaaaagggagatgccttatgtaggtgaaagatagctgggcaggaacaagactggtttaaaagtagaataatcataaagggtggatgaaaattattgcacattattctctgatggattttttcccttaaagctagttttcatgttgtaagcaagacaaatacatttaatatcctcctgc

SEQ ID NO: 20882 - DNA, 602 bp, Homo sapiens
ctattaaaattcataactatttcaaaggattttttagagaccctgaatttttaaagtaaagtaatacagactctactccgattatattgctaaatatcttaattgaatttttagttagttcttcccacctcatgccaaaatacatataaaacatatagatatgtaaaattcactttcacacataacttattataacaaaagtataagtctctcccttgtaaccagaatgtacaggtagatgccatttgcccactaataaaaccaaaaataaatcctattaggaaattggcctttataaaaactgcttagctctcacatgtttaaaacaaaacggcaatgatcttccaaaacctttattctccaacagtaaagataaaatgatgatcacccacctgaataaacatatttaaacttagaccaaatttaaaaaattaaattgaagtcatcaaaatcttaatctgtaaaagtattaaattttaaaatatattgtaatataacctttaactatatatcatttcatacaaatttctagtttaataacacaatatttcaaatccatcagttgtaaccattaacttaaatgttataaacatggcaagtta

SEQ ID NO: 20883 - DNA, 515 bp, Homo sapiens
ttccgagatgcatacaaccttttatgagttaaagaaaactttcatttaaacttaagctctcatgttaatcattgtgaaaatgtcctaaataattgaactctcattttcaaaaggaaaaattaatttgatcattttgcaattgcctgtcatagtctggaaacatgtggaaagtatattcacaaaatctagatttttgtctctctctggtttctcattttcttaccttaaaagcattcctttcccttaaaaagatcagttattccataactatgttttctcagttttgatattttaagaatatactcaaagctaaaacttcagtttactggaaatttcttaaaaaaataacttcctcaatatcaagttcctttttgcttccctctggagaactctattgacaaaagaccattgaaaatactttcagtcagtgactgtaaagactttccctatttacttatatgtttttcctctttggatacccctcctcgtatgcatctcggcagggtaccgagctc

SEQ ID NO: 20884 - DNA, 862 bp, Homo sapiens
ttccgagatgcatacaaccttttatgagttaaagaaaactttcatttaaacttaagctctcatgttaatcattgtgaaaatgtcctaaataattgaactctcattttcaaaaggaaaaattaatttgatcattttgcaattgcctgtcatagtctggaaacatgtggaaagtatattcacaaaatctagatttttgtctctctctggtttctcattttcttaccttaaaagcattcctttcccttaaaaagatcagttattccataactatgttttctcagttttgatattttaagaatatactcaaagctaaaacttcagtttactggaaatttcttaaaaaaataacttcctcaatatcaagttcctttttgcttccctctggagaactctattgacaaaagaccattgaaaatactttcagtcagtgactgtaaagactttccctatttacttatatgtttttcctctttggatacccctcctcgtatgctttcaatttgaggatgaaaaaagaaaacaccaaaattgtggtctgattactcatatcagttttgtggtggttttactacaacaactgcaataagaagaccatattttattctttctaggactagaatgaagaggggattaaaatagccattcattgcctctcttagcagtggggagagagagtgggatttgttcttctgcttcttttttttcttactccctttctctactccacttttttttttacctttcctgggctggtgttgcaaaattatcattttctccttcgttttattgttgtgaaactgtctggttcctgttttcctgaactatgatggcaattgtgtcccaaactggaactagaaaagaa

SEQ ID NO: 20885 - DNA, 549 bp, Homo sapiens
atagggtagaaaaaaaacccaaaatgttatgcttctcacaactcaccgaaatgtggccctactccttgcaaagaatggctcttcatatcaacacttattagaatgataaaatgttagagccaaaagggcccccaagtgtcactgagaccctcactatgcaaatggagcaaccccagggaactggtgactttcaatcaaggtcgcacatctggaaaggaggaggacccagatatggcccccgttctcaggtttgtaatactaatagctgggagagtgtttattaggtgcggttcagggctcagtgcccgatgcatgtgaactggtggaatcctcactgcaggcttctgaaatgggctctagcctccccgccgccatccgcctcgtcgtcattattgcgaccagccatctggggaaacaggtccagagaaatgaagtagctcgcccgtggcacacaacctgccattggctgagcaggactcaaccggactcccatcagcgcgagcccatctggtggatcacagcatagctctgagtgagcggccgcatcac

SEQ ID NO: 20886 - DNA, 306 bp, Homo sapiens
tcttccacactgccaccatatgatctttctaaaacacaagtctgattacatgcctttctcttgaaaacccttgaagcgaactttaaaatccaaagactttggaatgacatataaggccttccagaatctagcccctacctacctgtcttccaccccaaatctcatttcactaagctttctccaagaactccatactccattctcacccaccactgaccattccaaaacatgcaatgcttactcatcctccatgatttgctgttcctagaatgtccttcttcctgccttgcatggtcaattcttctt

SEQ ID NO: 20887 - DNA, 505 bp, Homo sapiens
agatgatgtggttgggctctgtgtccccacccaaatctcatgttgaattgtaatccccatgtgtcaggggaggggcctggtgggaggtgactggatcatgagggcggacatcccccttgctgttctcgtgatagtgagttctcatgaggtctgatggtttaaaagtgtggcacttcccccttcactctctctctttctctcctgctgccgtgataacacatgccttgcttccccttagccttctgccatgattgtaagtttcctgaggcctccccagccatgtggaactgtgagtcaattaaacctctttttttttaaacattacccagtctcaggtagtatctttatagcagtgtgaaaacagacttatacagcagaacttgatcctgggcctctcaattcccagtcctgagatttttctaacccactttgcccctttatttatctgctatgtatgtagccaaaaggtacaaacaaatcaaaagcatttgccaacaggaaaaaa

SEQ ID NO: 20888 - DNA, 383 bp, Homo sapiens
tgacaaatagaatacatttagactcttcagtcctaggattgcattctgtcactatgttcaagaataatactgaacattattaaaaaatgaaaagcagatcagttgaaaaggtttctttaaggcactactgaagtttatcataatgggagacaggtaatgataactttcaagtaatggaatctgtgctacagtacattcacttgacacattttctttgaatgaaatagttttttatttttttaaataaaaggcaagccagctttctcttcccccatttaattagggcagctacattgtaggcactaggaaaagaaaatcggtgattttcaaatcagtggggaggatacacacacacacacacacacacacacacacacacacac

SEQ ID NO: 20889 - DNA, 174 bp, Homo sapiens
gaatgaagatctctattgagctggtatggaatgatagtcaggacatagtgcaaaaagcatttctcaccttcaggtgagcaaaaatatagaagtttgataacattgtttgttggtgagaccatagggaaaagtcataaaataatatctatagcatactatcttttatgtaagaaa

SEQ ID NO: 20890 - DNA, 241 bp, Homo sapiens
gaaaatttgcaaaacacattaagctaaaagatagatgatagatagatagatggtagataaaatcaaaatgttattttggtgtgggctttgttatgggtgatgtttttatgtgtgacttcctatttatttctatttttatgatataacacaaaatatcagtaaaatgcaacaaaaaagttttaaataaatgaagaaaacaattcaaagaagtgttcagatatgtaacaataaaattaggaat

SEQ ID NO: 20891 - DNA, 617 bp, Homo sapiens
cctaggaaaggtaaatgacttttcttaagtcacatggctcaccacagaaccaaagctggaacacacataccctcagctcttcttccagtgctttcaggtatacaagtatttgaacaggattcaaggtttaactccttatgtgtcattcagtgtatccagtgtaagtaaaatgttaccccttagtcagaacagccttgagaatttctcaatgactacaaaccttgcttagttctatacaagggaagtaaaagagagagaatgtcatgaccaaatgacttaacttttgaaggcagcctattgcaaacttgaataattggggcatgtattttattgattgtttgacctataaggacagatattttaaaatataaattcaaaattgcttttttgcagcattcacctgtaggccttctatatctgctctttgtgaaatagatggcttccagagcattaaaaaaagaaatagacattttcttggttcaagagctgtaatctgctttccgagtgatttttcatagttaagcatattttatgtgcacatagtttcatttgagatctgagaggatttcatctaaaacggaaaagttattacctgtgaaggagaacaaaggaaaagg

SEQ ID NO: 20892 - DNA, 741 bp, Homo sapiens
ggatctgggttggggcagtagtctctggtcttcttggtttcttttggaatctcttctcaatgacctaggtgggcattgtactccgctattctcagactgccatgactgggctggatattttaattggggtggtggaggaagctggctcaaggccttttggcagttcttttctagaatttgaagctgtaggggttgaggagcactggtggcttgcaggagatagatgcacacagagagaggtctggagatctgtaaaggggcctccatgaatgttcagcaaagtactaatcggctcatgtatatgaggaaatgagtgaaataacttttgaaaagaatcaaagggaacagtacacaatactcacatagggcctggaaaaggactgatcctgccagccagagtggaaaaactcgtaattcagagtattgggtagagtgttcagaaaggtcttttctccgtggtgaggagtaatgtgccccaaactgagcactgctccagatttgcctaagaaatcataaaagcaagacctgaaagtgtcacattgtttccaagtgacttaagtgcatcctagaaaaaagcacaaaaatacttataggaagccaaaaggacccaacatccaaccaagtaaaactctcagtcttctgtccattgaaatattaccagacttacagacatgtgggaaaacatgagctttctcaaagagactaaccaggaaattgaaatggactcagaattgccataga

SEQ ID NO: 20893 - DNA, 320 bp, Homo sapiens
ttttttttttgagatggagtctcgctctgttgcccaggctggagtgcaatggtgcaatctcagctcactgcaacccccgcctcccaggttccagcaattctgcctcagcctcctgagtagctaggatataggtgcgcgccaccgcacacggctaatttttgtatttttagtagaggcggggttcactatgttggctaggctggtctggaactcttgaccttaggtgatccctgctgggattataggagtgagctactgtgcctggcccgtttatgcaatttttaatcgttctataaaagacatatatttcttgtataacc

SEQ ID NO: 20894 - DNA, 998 bp, Homo sapiens
gggggtccggcccctccctcccatctatctccatttcccttctagtttgagtcacaacagcattctcaggaaagtgccctgtacctgctggagacactgccctcctgcccacgtgtccgggaggcctcagtgaagtaaggggatgttggtccccgaaaagcccctttctgctggccaacaggtgcccctggctgatgatgggagaagcaaggcacccacactttgtggccttccatctgggtggcttggagcaacctctgcctttctctgaatctcagggtttcctgggcatgggatcataatttctatcccctgatgcccgggtgccatggggaccatggaggccatggggtgggaaggccaggtattgccatgctcacagaatgagtttgggggtctcctctggttctgaggcctccatcctcccttgtccttgtgggtgcagccccgcttccctctctgtgccctgtgggtgccctaggtgcctaggaagctggcatgtctgggcaccgtgcttccccaggcccttctctctgcagcctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcaggtacctcctcccccgctgcctccgggaggggccatggcatgaatgggagcaggggtgggcactggagtaagaggcccccaggatcatggccccagtcatttcctgtacccacaaccctgccatctggaccctgagcaaaccctgtccatctgtcccagagactccacaaggcacacagagaaactgtccttccccacactggaggcctgtgctttgggatttaag

SEQ ID NO: 20895 - DNA, 1084 bp, Homo sapiens
gggggtccggcccctccctcccatctatctccatttcccttctagtttgagtcacaacagcattctcaggaaagtgccctgtacctgctggagacactgccctcctgcccacgtgtccgggaggcctcagtgaagtaaggggatgttggtccccgaaaagcccctttctgctggccaacaggtgcccctggctgatgatgggagaagcaaggcacccacactttgtggccttccatctgggtggcttggagcaacctctgcctttctctgaatctcagggtttcctgggcatgggatcataatttctatcccctgatgcccgggtgccatggggaccatggaggccatggggtgggaaggccaggtattgccatgctcacagaatgagtttgggggtctcctctggttctgaggcctccatcctcccttgtccttgtgggtgcagccccgcttccctctctgtgccctgtgggtgccctaggtgcctaggaagctggcatgtctgggcaccgtgcttccccaggcccttctctctgcagcctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgtgagtgacccacccagcccgtgaggacagcagaggggtgggggcaccctgccagagccacctcagtgactgacctctgtctccaggctgacccagtgctgcctgggccagaagcagctggccatcctcctgagcttggtggggcgacccgcagggctgttcagcctcaggtacctcctcccccgctgcctccgggaggggccatggcatgaatgggagcaggggtgggcactggagtaagaggcccccaggatcatggccccagtcatttcctgtacccacaaccctgccatctggaccctgagcaaaccctgtccatctgtcccagagactccacaaggcacacagagaaactgtccttccccacactggaggcctgtgctttgggatttaag

SEQ ID NO: 20896 - DNA, 392 bp, Homo sapiens
caccaccagtaaggtagttatatacattttacatagaatttttaaagttctctggattatacagaatctataaagccaataattttcacataggtagttgaactacaccatcgatttatgcgattatgaattatttagctaaagactggacaatgggctccctagtatagttccacaaggattgatcttttggagtgacaaataacagctttacctagcatgcatctcaaaatttaatacaaggagattaacgtattgacaaaatagctgtggtctctttcacttgggtacttcgtcttatacatttttagaaataagaaaaacagagttattttgaattaaagctggccttgattttatcttttctgctttttctatgtatgtaattttta

SEQ ID NO: 20897 - DNA, 198 bp, Homo sapiens
gcggaatgcagtgaaatagcatgagaaagagcgtttttatgtacatcacagacaagccttgttctgctgaagaggtgatgccacgaggtggggaggagctcacttcaggcaccactcccacttccattgcccgcaaatccaggaaagaaatgactaatgaactctagtgatcgcaaactgctcaatcggtactcatca

SEQ ID NO: 20898 - DNA, 501 bp, Homo sapiens
atgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaatatgtattt

SEQ ID NO: 20899 - DNA, 509 bp, Homo sapiens
acttgagtaggtaaaggaggcagccaacgctaccacaggtgtgggaaaaaggtgtcattgaagcctatggactggacagttgggtaggaaccagaaggccaataggaaggagggcaaaggtgcccaactgaagggtaagcatggcagtgagtatggtatgcctagaataaagatggttgggattagaattgggtgacagtgattagtagtttaattcagaagtatctcttcccaactcaaaagtctcactttgggctgaaagtacagaggaagaaggtagacttttaagaagtctgaataagcccccaacttctggagtccctttctcaattcctgttgggagtgggaaatattataaattactctgggcattaaaaatagcttagtttaacctcgattgtggagttaaaaaataacaaagattgcattggtcaaatctggacaatttgagcattcaaaagaataacaacaataagttacaacatatttaatataaagaagaatccacg

SEQ ID NO: 20900 - DNA, 389 bp, Homo sapiens
agaggcagggaaaaaaacacaaaattactaaattatgttacatgctaccaagaaataaaatggtttatgcaataaagagaaatgggagaacctatctagactaagtgttcaaggaaggccttctgaggtacatttaagtttatctgagctcacttgctatgtgactttcagcaagttactttcaactagagcttaggttcctcttctgtaaaatggggatgaatataatgccacttatttcacaaggttgcaatgaagattaggaatacaggtacaggctgagtgtggtgacacatgcctctaatcccagcacactgggaggcagaggcaggaggatcgcttgagcccaggagtttgagagcagcctgagcagcatactaagaccctct

SEQ ID NO: 20901 - DNA, 403 bp, Homo sapiens
ttgctttttgcttttgtttttattttttaaagatggggtctactgtgttgcccaggctggattcagactcctgggctgaagcgatccttctgcctcagtgtcctgagtaggtgggactacaggcccatgccaccatgcccaggtcatccagctttgttttggtcatggtatatcttatccttctttgttaccatgatgtatcttttctatacttttactttcaaccaatttgtgttcttatacttaaagtgggatttcttaaaaacaggttatagttgtctttttttttttaactctctcatatctgccagtctgataatatcagccttttaattggggtatttaggactatttacattttatggctattgttgatatggttgcttttaaatttaccatcttg

SEQ ID NO: 20902 - DNA, 375 bp, Homo sapiens
agattgtgattctcctaaggtaggtctccttctatagccccaactgagcttctaggctgttaagcaagaccttctacactggctgcgacaggactccaatatctctcagcattgtgtgaccttcagtgcctctgttaagcattcagttctgcagaaggcaccctctactgtgtcttacagagtcccactctgtgaatatacagcctagccactggccaatggcacacaaggaaccctcattaaaccaatacaaagacaagttcaacagtattttacagaaaatcttttaagccaaagagaaaaacagtcatgattaactatgttggcaataattttaaggtacataaaaaaagatatttgtaacatatctgtatt

SEQ ID NO: 20903 - DNA, 1555 bp, Homo sapiens
cacaaagcacctaggccatggtatgtgcttaataaatggtggctgtgcttggtgttacctgactctctactcatcctttgggatttgggtgcctgcctgtccgtccagatgtccttgagatctcacgagttctctttgagtgcaaagacctcattctcattatcaaaccaggctggtcccagacctcagagttcaggtcttcatgctggaatcctgggaagcactgaacgtggagtcaggagatgtgggtttgagtcctgagatttgctgtgacttcatctggaagatggggttttgataccttttttaaaggtatgaaatgatgatgatggaagtgttttgtgcctagaaaggcatttgttgcatctcaggcattcttttcattctgaccacccagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagag

SEQ ID NO: 20904 - DNA, 1398 bp, Homo sapiens
cccggaagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagag

SEQ ID NO: 20905 - DNA, 1539 bp, Homo sapiens
cccggaagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagag

SEQ ID NO: 20906 - DNA, 3216 bp, Homo sapiens
cccggaagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgctacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 20907 - DNA, 2044 bp, Homo sapiens
cccggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaagcaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaagtacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 20908 - DNA, 774 bp, Homo sapiens
gtgtctgtcggctctgaggtgtccccgtcgctcgctctgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 20909 - DNA, 1221 bp, Homo sapiens
cccggaagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccaggtagagagctgtgagccccagccccacctgactccagcacacctggcgagtagtagctgtcaataaatctatggtaaacagacaagag

SEQ ID NO: 20910 - DNA, 214 bp, Homo sapiens
ttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctgccactcaataactctgtcaccctgaacaaa

SEQ ID NO: 20911 - DNA, 1557 bp, Homo sapiens
cccggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaagcaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgg

SEQ ID NO: 20912 - DNA, 2185 bp, Homo sapiens
cccggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaagcaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaagtacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 20913 - DNA, 2605 bp, Homo sapiens
cccggaagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaagcaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgctacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 20914 - DNA, 271 bp, Homo sapiens
  misc_feature (214)..(214): n is a, c, g, or t
  misc_feature (223)..(223): n is a, c, g, or t
  misc_feature (232)..(232): n is a, c, g, or t
ttcacgggtcgactactactactaaattcgcgtccgcgtccacttttgttataatattgtaatctcagttcaaaagttaactgcaaatataaaacccaatgatttctatatagtaaattgaactgtaaaggtaaaaaaaaactttacattaattcagaactttttagcataccaaattgaaatacataggttcaaatttcagatttatggcaancagtcttcnaatacaatncagacatttcttaaaagttccgtcgacgcggccgcgaat

SEQ ID NO: 20915 - DNA, 950 bp, Homo sapiens
  misc_feature (893)..(893): n is a, c, g, or t
  misc_feature (902)..(902): n is a, c, g, or t
  misc_feature (911)..(911): n is a, c, g, or t
cactccctgctttcagctgatagaactctggcaggtgaacttgattctagatagaaaatgagaagaggactctactttccttctggggagtctatccagcccaaggggaagctctaaagatactgacactagggcttccttaaggacagggttagattaccctacagtggacctcatagtagacatgcccttccaaagctcagagctcccagccagcatttcagtccctctccccgactcttaatcatgaacatacaaccaaagataggcacatatctgaggggacctctaacggtggaagacagaaaccacaataaatacatgcccaaaacaccttggaagatgtagaggcctggcagggagaataaaacacaaaacaaatgagcaaggataagcaaacagtatccgtgatgccttcagaaagacaaaagaaaaggttgcatccacaaaacagtaacacagtgctatgcaaaaagaacattcagaggagaaaagaaccggtcctgaaataagatagcagaaattgaaagatcagtagaagagttggaagataaaattgaagaaatctcaaacgtggaacaaaaagacaagaaaattggagaaaacgataggagaaaatttaaaacaacaataaaaagaaccaggtcaggaaatccagcctccaggtaatgggtttcaacaagagagatcagagaaaaggaacagggattacaaagtaaggagtttgttataatattgtaatctcagttcaaaagttaactgcaaatataaaacccaatgatttctatatagtaaattgaactgtaaaggtaaaaaaaaactttacattaattcagaactttttagcataccaaattgaaatacataggttcaaatttcagatttatggcaancagtcttcnaatacaatncagacatttcttaaaagttccgtcgacgcggccgcgaat

SEQ ID NO: 20916 - DNA, 420 bp, Homo sapiens
gaaaaggttgcatccacaaaacagtaacacagtgctatgcaaaaagaacattcagaggagaaaagaaccggtcctgaaataagatagcagaaattgaaagatcagtagaagagttggaagataaaattgaagaaatctcaaacgtggaacaaaaagacaagaaaattggagaaaacgataggagaaaatttaaaacaacaataaaaagaaccaggtcaggaaatccagcctccaggtaatgggtttcaacaagagagatcagagaaaaggaacagggattacaaagtaaggagtttgttataatattgtaatctcagttcaaaagttaactgcaaatataaaacccaatgatttctatatagtaaattgaactgtaaaggtaacttgtgtgtgattctgaatacatagataaatgtttaa

SEQ ID NO: 20917 - DNA, 2853 bp, Homo sapiens
cggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaaggtcctggcagcatacagggtgttcatggagcgagtgctcagcctcctgggtgcagacgctgtggaacagaaggcccaagagatcctgcaagtggagcagcagctggccaacatcactgtgtcagagtatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgc

SEQ ID NO: 20918 - DNA, 656 bp, Homo sapiens
tcatccagaaataaactcttgtacttctatactaattaaagattcatgtaaattactaagttcttggaaaactatggagaactctgtgggggctgtcattcacactttagtatgaattggtttaatgacgactgtgatattggctacataaagaaatggacgtttttatttggggttaggggatcacagatgtggactggcttaggtagaatggtccctgagcaaaggagatattgaagtttatgaggatgtgcaagataagcagatttacttttgcattttattttgggctatctcagcttcttttactagaagctcatgcctataatcccagcaccttgggaggccaaggcaggaggattgcttgaagccaggggttcgagatcagcctgggcaacaaagcgagaccctgactcttaccaaaaaataaaaataaaaataaaaaaagaaactacttgagaagtgtaagtgttaagaatagcccagataaacactggaaccaacttaatttagaaagaaagaaccatttcttcctttccctactctggaaaatttagattgataaaatatgggggaaggagaaatactgatttctgtagttctaggactcatggttcctgtctgcttagaattctagctcgttggtacagacgtag

SEQ ID NO: 20919 - DNA, 457 bp, Homo sapiens
gaagtattattccatattttaaatataaagaaattgatatcaatgaatgagtattatattatcttactcttcaaagatgagttttaagacttttctgatatgctttggaaagttgataagctttttgaagcatctttatgtttttctattctcaagtcagtctcaaaaagaaaggaagaacagaaaagaaagaagagttaaaacatccttttgattgccgagttgattcaccttgaaagagctgtactttgacattggtctcagattcttactcgtgtgccctttggtctgggagcatagcatttgcaaccttggaattggttactttaacttttttcaaaatggggtaaatggcttacctctttgaaagatacttcaaaatcaagataatatttgtgaacagggtttgaaaaatggacgtgagtcagagtgatggaaatttcagttagactgcaca

SEQ ID NO: 20920 - DNA, 126 bp, Homo sapiens
gagcatgttttactctagggcaagcaaggagctctatggaaggcagctgggcaagctagttaaaaacactagttgtaatcctgcctctaccacttactaactttggaatctaaacaactgtctcac

SEQ ID NO: 20921 - DNA, 346 bp, Homo sapiens
gcagtctctctccagccagaaaggttttaaaaatactgaaatactgtaatatacagaagatacgaaatataaacaatacagatgtagagatgccaaggtgaggctggggaattccaaacagaaagtgtaatgtcagtaaaggcccagagaaggggaatatttggtaaataaatagaagtactcttagtccaattttgttagagcatttgggatataagaactttagagataataattgtattccataggaacttgggagttattgaaagagaatgattggattagctctattttttagaaagtttccatttctagcagtagggtgactgcagctgggaccatattc

SEQ ID NO: 20922 - DNA, 490 bp, Homo sapiens
gcatcatacagtagtcatccttttgtgactggctaatttcacttagcataatctcttcgtgcttcatgttgtagcatgcgtcagaatttccttctttttaaaggctgcgtaataatccattgtatgtatatcccatgttttgtttatccatctatttgttgcttctacgttttggctgttgtgaataaagatgatatgggccgggcgtggtggctcacacctgtaatcccagcactttgggaggtcgaggtgggtggatcagttgaggtcaggagttcaagagtagcctggccaacgtggtgaaactccatctctactaaaaatacaaaaattagctgggcgtggtggcatgtgcctgtaatcccagctactcaggaggctgaggcgtaagaattgcttgaacccaggagttagaggttgcagtgagccaagatcgcgccactgcactctagcctgggagatggagcgagattctgtctcaaaaaaaaaa

SEQ ID NO: 20923 - DNA, 624 bp, Homo sapiens
gagtattcctagaccttgtacttatctcattgtcctatgctcaggcaaacgtttgcaaacagcagggaaaacaactgcagattgagacttgagggagaagggtgggagatggtccttagcagatccctgggcctggggatcacctgctccctgggatcaacagaaccagctgtggagaatctgctcgacagtggccttggaacagctgcggctgctgcaccaagaagggagggcaggagggcggagcggtactggtggaagggtgagctaggaggaaaggctgcaaggaccctgccacgccacctcccggcaaaccaggaagtatttttgcagtaagtgcattggactgagccaccttttgaacctacccgaagtgttaacagcgcacagcaggccttagatgggtgcaataactgcaaactctcaacgggctggtgcctaagaggctacgggctggcagctaaatagagcccggcgcagtgagtcgcgttgtccgaaagtacacagagtggagccagccgactgtgctgtctttgcaaaccgtgaccgagcaaagtccgcggtaaacaagcctcgcagcagctgcctccggatgagcgccccctgctcattcctccacccagc

SEQ ID NO: 20924 - DNA, 570 bp, Homo sapiens
gagtattcctagaccttgtacttatctcattgtcctatgctcaggcaaacgtttgcaaacagcagggaaaacaactgcagattgagacttgagggagaagggtgggagatggtccttagcagatccctgggcctggggatcacctgctccctgggatcaacagaaccagctgtggagaatctgctcgacagtggccttggaacagctgcggctgctgcaccaagaagggagggcaggagggcggagcggtactggtggaagggtgagctaggagtgcagtaagtgcattggactgagccaccttttgaacctacccgaagtgttaacagcgcacagcaggccttagatgggtgcaataactgcaaactctcaacgggctggtgcctaagaggctacgggctggcagctaaatagagcccggcgcagtgagtcgcgttgtccgaaagtacacagagtggagccagccgactgtgctgtctttgcaaaccgtgaccgagcaaagtccgcggtaaacaagcctcgcagcagctgcctccggatgagcgccccctgctcattcctccacccagc

SEQ ID NO: 20925 - DNA, 399 bp, Homo sapiens
agttttttctcaatagtctattcaactgttaataaatccaaactggattagcattatgactcttcactaataacgtgtgacccagaaaaaaacaaagcttggagggacacaaacgacaaatgagctgttttcattgctttgtggctacaatgttgcatatttcatttctgattcatggaaaaatatccagcacacagaagtcagctagctctgtgaaaggccttggaccagggaggttaagaataaagtcccaatgtcttagtcactggggcctaggaagctgacctggaagatgttagcagcagaaagacttttgctaggaaactgctctctgaatctgctaccctcttgctcccacagctttgtttaagcagatcactaaagatttatgtattgact

SEQ ID NO: 20926 - DNA, 278 bp, Homo sapiens
aagcagatattgaaaatgaatagctcttaggacagactatcaaataaatgtgagccagaagatttttaatgggagaaattaactttaatgaaatatcttgtagaaagagttaaaaacaagatacctgccaatcccagtcactctggagagtatctaatgtagcaatgaaagtaaaaactagttaacattctccagtgtttgtcaagtttaggaagagattaacttgaaaagctgtggttgggtagaaggtttatttgaagatcgtttggcatcatagc

SEQ ID NO: 20927 - DNA, 378 bp, Homo sapiens
ggtggggtgggggggagtggggatgagggtataaagggaaaggggtcaggaaaaatattccagacaaaaggaacagcatctgtgaaggcctaaaagaaagagcaaagcatgaaacggagagaaacagaaataattcattatcagtgaacataaagttaagagcagaacatgaggagaagactcgggatgaatagggtcccaatcatgaagggtcttataagccatgttagagacactggaatcaatcccaaggacacagcaaagctagataaaggtcatcaatgaagacatgtcaagatcatattagcccattttgaaatgtcatcctcactgccttgtgaaagtggatatacagaaagagcaaccagaggtgaggga

SEQ ID NO: 20928 - DNA, 474 bp, Homo sapiens
gagaatgttgcagggtgcaatttctccccatctctagagaagccattgggaaggtcaacccataggaccctccccagggccaggctggagctgaataaagagccctctggctcgtcttagtgtcagcagttattcatcagagaacttgaattagaactcacatttctcattactggataatgtgagagagcaagcatgggttccagctaatcaaacatgccatgtgccaagtgagcttgagtcctggagagaattaactctaagcctcttaggctaccatcctttacccactggatgagcccgaggggcatctggggcagcagtgacagagacctctgggcaagatatgcccagaagaggtgtgatgctgcgcccagcttctcatgagcgatcaccaaaactgatcacaaaatatgcaccacataagagaagagtaagataaacactgttaaacaagatcatgtaagaagacta

SEQ ID NO: 20929 - DNA, 291 bp, Homo sapiens
caccagccactgcatctggttctttttattttcttactggagaaaactgagtctcagagaagagaagtgacctgggcatacagaatagtttttagttaagtgaggaccagaacccaagttttcttttcaccagagtttcccaaagtgtgcaatgatatggggtaatacaggggtgaatctttcttttcttttctttcttttgagacagagtttcactcttgtcacccaggctggagtgcaatggcgtgatctcagctcactgcaacctccgcctcccaggtacaagcgatt

SEQ ID NO: 20930 - DNA, 498 bp, Homo sapiens
gaaattatccgaactcaaacccaaaatactccaataagttgtgtgattcccttaaggcttttttttttttgcacatgctgtacacttatctgagatacagttcttagacccctttcccttttaaattacatttctcaatactcccttctcatagcactcttcttccaatgcagtttttacagttatgtatatgttggtgtactttttagttttctcgcaagatatcaaggatttgtgagattgataatttgtaataggccaggcgcatggctcacacctgtaatcccagtactttggggaagcttaggcgggaggatagtttgaggccagcctggacaacataagcgagaccctgtctctactaaaaataaaaaatttagccaggcatggtggtgcacacctgtagtcccagctactcaggaggctgaggcgggaggatggctgagctcaggagttggagtttacagtgagctataattgtgccatgacactccagac

SEQ ID NO: 20931 - DNA, 813 bp, Homo sapiens
cctagattagatgttttctgacctgtctccctaagttgttcctgtcacttgtgtctgtcattcgctcccccatcgcatcctgcccaaccctccctgtctatgattcgaattgctctctgtccagatcatttcctgcagtgaaaaacgaagaaagactttctcccttcttcccacctacacattccttttgtcccccaagatatcccttcctcttgcctggaatcttcccaggccttaattgattgatttaggccccctttgcaccaggcaccctagcggaagcccagaaagccccaagagtctggatgtgttttggagagcaggctcaggttcactgcacactaatttgcagcaggaagtgctaggaagcccgatgagggatgggaattagcaaataaggttggcagtcaattgacagaggaagcttaaggaagaggatcattttgaaaaggaaaaataatttaatccttttcaggtgtgttaatttctttcgtggaccaaattaccatggacctggaatagttgagattttccctaaggtctggctgtacttcatagggaagaagcaagggtaagtgcagtaaatttgattatggacaccagtctaactctagcttaatgagccatggaaacaaaatagctcaatctcttctaactgctgtaatgcaacactaggagcattgagagcactgtggttttggttacacaaatttgtagtacaggccttgcctcagcatttgaacatttcagcaagagagctgaacttgcttcgttcttcatgtagcagatataagtcttttggaattaatttga

SEQ ID NO: 20932 - DNA, 231 bp, Homo sapiens
gagtcaaatatacagagtgaataaaagagtgggttaccaggagcaagtgggtggggaatgggaaatgtaggtgaggggtaagaaaatagcaagtatgtaggatgaaagagcctagagatctaatgtgtaacatgtagctaataagaggactgtagctaataaaattgtactatatttggaattcctgctaaatgaatagatttttagctgtccttgccacaaaaacaaacc

SEQ ID NO: 20933 - DNA, 342 bp, Homo sapiens
tagcactaaatcccacatcaaaaagttaggaagaactcaaattaataacctaacatcacaactgaaagaactagagaagcaagacaaaaccccaaagctagaggaagacaagaaataactgaaaatctgagctgaactgaaagaaaccgagacatgaaaaaaagaaattcaaaagatctatgaattccgggtaggtttcttgaaaatattaataagaaagtctgctagcagactaatacagaggatgattgaaagaaacacaattagaaatgacaaagggaatgttaccactgaccccacagaaatagaaacagccatcagaaactactgcaaacacttcta

SEQ ID NO: 20934 - DNA, 660 bp, Homo sapiens
ctgtccccaattccattcaaggttcagttgtgttcagctttaaaaccagctatgtgaatgtgagttctagtgcagattatttagtgattatgtaactaaaattgatgaaaaaatcacactatacaactgtgaggagcacacaactgctaagtttgtacttttgaaagtaaattattctttgtttgataccttattttttaagaaagtgggattaaaaatattttggtcagtgctgttttctacccaccttcaaaagccaatggtttgatatttctattaatttgtgcttcctttagttttaataggggatagaagactgcagctggttgggtctggaaaacattaatctgggcaaacggagctggagctatgaggatctgagtcctagggggccctcattcactagcagtaagaatttaagtggtgcatggcacatagcactgtactagattctgcaggggcacaaacatagagccaaacactctccctcttggagaatttcagacccagaaaaggccacgcagttctaacttttgtcatcggttccttttgctaaaaggcaaagggtatgttccttgcctattgtccaacataccccttccaagattgtgagaagatgggtagctgggcatcaataaatattgaatcaattgacctatg

SEQ ID NO: 20935 - DNA, 189 bp, Homo sapiens
gaagagatgtgctgcctgtagcccgaatgccctaaagagactgtatagttagataatcctgtggctccagataagcgtgggtcctacggtaagttgcaaaagcctagggctttttgcagcccttggcaggtgtttcgtagcaaatctcaaagtttcgtggtcactcaggacaacctcctttctgctgag

SEQ ID NO: 20936 - DNA, 640 bp, Homo sapiens
gagagaagtcggtgcctggcttcaaagcttcaaaggataggctgactcttttggtaagggctaatacaaccagtaacttaagttgaagccattgctcatttcccattttgaaaatcctagggctcttaagaattgtgcttaatcaactctgtctgtgctctgtcagtggaacaacaaagcctggatgtcagcacatcctctttacgggatggcttactaagtattttaagctcaccattgagacctactgctcagaaataaaagactccttttaaaatattactgttcattgacaatttagctggtcacccaagagctctgatggagatgtagaaagaaatgaatgttttcatgcctgctaagacaacatccattatgctgccactgatcaagtagtttcaactcttattatttaagaaacagaatccatagaacatttgtggtagtagcgcagagttggttacaatgtcctaccacagcaatttctgacattcaaattgggcctgtagcaatgggactccttttgattccttcagctttcgtattatgttggttatctatacagcaggtttctaaattgaaacactttcactcacatcactcatatttccttcgtttttggagactaacagcttgatct

SEQ ID NO: 20937 - DNA, 452 bp, Homo sapiens
ctcctgacctcaagcgatctgcccaccttggcctcccaaagtgctgggattacaggcatgagccacagtgcctggcctacgtatttctttttaaagactgacttttcatttagattaaatgattgctcttctaaagtaatttactctttgttggttttaagaaatcttttgcatgtataaggtataaaacaacaactgtttatatgttacttccattagccgatgaactagcggttaaatgatgcttcaaatagaaaataagttaattccactaatagattgtgttttcattaaagtcataaacatgaaataacactttacaaagttcattttgttgagtatcttgcattactgtgaattatattgtaaagtagtttaaagtttaacattaaagataaaattattatttttgctgttatggtatgaataaaaaaatttgattaactttttta

SEQ ID NO: 20938 - DNA, 419 bp, Homo sapiens
cattgtctctcaaactattcacttgccactttctaattttataatctccacacctttggaatttgccaatacaacagagcagtagacaattttcttggacttcatgcttgatctgcttcaatctatactatttgttataaaccttcatgactgacagatcagacctatcatcttggatcctctgtagtggcataattttgtctttgacagattataacttaaaattgctgagaatactctgtcaactttaaaatgtatctgtaatatttacaagtatatcattcgtcttaagtactacaaaataccttccccttatgagagtcagttaactatttttaactagttgcattaaaaagtgaaaactatttttcatttctaaatatgctattctcttctaagtaaattaggataaagtactt

SEQ ID NO: 20939 - DNA, 1044 bp, Homo sapiens
agaagcaatagatcacattttcctatttgtttatgaaagtacagtcttattttcagcctaaagaaatggacacttctcagcataggcggacgtgattggttgtggtatgaatccttttcctaaccaggatccataatatcacagacaaggtaatatagcactgtgaaggatgtgtctttcttcaaatggagccatgagagatggtggttttttaagttgatttgatgttggatgtagtaagtcctgtgggagagaatttttttaaataaaaaatactgtttaaaagtgtctcttctaacttgatctctaccttttcccctctccacttctaactgccccccaccagctacactttcccagtttgaaataatgaacaataccttttgctgacagaccaaaccttagttcctgtgggcaaatgaagggttttttccccccaacaatgaacaattttcttgaaaaagtctctcaaagatgttcttattgtaataaccctccttcaacccaaacagcctaaatgattggataaatgttacacaagatcaaggagcaaccaggaatttcacagctgactcagttactgattactttgcaaaaatagaagccaagtcttgacttaactggtaatagactcagagtttgagtttgctctgggtggggtgctgatccctttttcacatgacagaagtgattgagtaatttctaatgtgctggtgttggatggctttttctttctcactatcccatatatttttacactttgatatttccctgaactaatattccttgcaacttatttcagtcaacaggatctttaagcatcagcactatgctatatatgtaaaaaaaaaaaaaaaaaatttgactgagccaaatggctccacagagtgagttgtcaaagtgtggaatgaagagaatggagattgccgatgtcaactagaaatggcttcagctaccttgtgggcttctggggagcaaacatttgctctgcatttgggtgaagggaaagtttcgcatgaatacgtgctcggtcgtctctttgtc

SEQ ID NO: 20940 - DNA, 499 bp, Homo sapiens
ttcaaccctggtgaatgtaaaacacttcaaaactattgctctaggatctaaatgaaattttattttttaaatctgtaaagaagactggcccaagggattagttatgagacaggaaacctcctctagtttaacattcaaattcaaataaggtcagtgcagagcaaaggtcattgtcatgctaaaggtatctagcagcttccatgaaatgaattgataagcttaccactccctagtgcacatagtatcccatcaggaaacccagaacgaacaatcagagtactgcacaatatttagaagcacaagtattagaaccagacttacttatactcaaattatggctccaatactaactagctataggcaaaaagcttaggctgggcgcggtggctcacacctgtaatcccagcactttgggaggccaaggcgggtggatcacgaggtcaggagttcgagaccagcctgaccaacatggtgaaacacagtctgtactaaaaataca

SEQ ID NO: 20941 - DNA, 382 bp, Homo sapiens
gggaaactccaggggttttagaatctccctcccaagaatcagggacaaaactagtataagtctttattatacatcaggtgtactgcatttttctgcacattcatttgttgctttttaatttaagcacttaattggaaagaaattttaaatcttaactgaaagttagcccttctcattcctctatccctcttatacacgatgtacattcattccatcaaaatatctcttcacattatttaataaaactgatattaatccactactttctaaaacttccatcattctaattcagatagccttcaactgtcacctagaccatgacaggtgccactaaactggtcttttttcttccatacttgcccctctactgactatgcctcaa

SEQ ID NO: 20942 - DNA, 381 bp, Homo sapiens
caacaatttatttagctcttgattgttctgcttgttggcagtttgggctgagcttggctgggcagttcttctggtcttggtctcctccacgtgtctgcaggcaactgtaggtcctccgggtagctcttctggggtttggccggctattggctggggtgtgaggggcaactggtccctgtggtttcatcacccagcaggctagcctgggcttgtcaccggccactaagcaagcactctaggaacaagaaacggtcaatccccgaaacccaagtgcttttcaagcctctgtctgtatcatttttgttcatgtccctttggccaaagaaagccacaagacaaacccagattcaagaggtggaggaaataaattctgtctcttca

SEQ ID NO: 20943 - DNA, 125 bp, Homo sapiens
aaaatccaactacagaaaaatttttaactgaaagatgccttaatagaatgatctatatcccttagagaaaagattaggacagtcctttatccccttgaattactttttaaatttttaattttctg

SEQ ID NO: 20944 - DNA, 397 bp, Homo sapiens
agcctttttgcccagttttccattgggctatctttttcttactgatttgtaggcgttctttatgtatgctggatataagtcctttgtcttatatgtgtattatgaatatcttttctcagtttatcaaccttttcctccatgtgtccttatccctttttgtgccctgtaagaaatctggcctcctgggatcccatctggaaagtgcttagtattctgcctgcttcacaaagggagggaaagcaaacgtggtgaggcaccctttccattccagcttgctcggtagctggtgattggaagacactctgtgacagcgttcagtccctgggcaggaaaacctcctttaaggattcttcttccttaactgggtctgcttctttcctaaagaaaaaaaaaatga

SEQ ID NO: 20945 - DNA, 359 bp, Homo sapiens
ataaagagttaagattttttgtgcatagttgggtagcttccttatatatattttatctaaattggcaaatcaattttaagactcagagtccttaaaaatatgcatttgtgtgtcagtaaaagtaaagtaaaaatacataaaaaatgagaggccattgaaatcctaaaagattactgattcaaagtcaaagagaaatgacatctaattcctctggtatatgttagtattactaggtggttaacgttgccagctttggagctgaattgtctgggatcctggctccactgtgtattagcttcatgtctcggtttgctccactgtaaaatgagaataacaatgagtggcctcacaaagctgct

SEQ ID NO: 20946 - DNA, 1648 bp, Homo sapiens
gtaagtaaacgtgatgataattataaacaacattcaaataaccttggaccttggtgaaatgacttgtggtggccagaatggtgcaacaagatgttatttgcaagtttttttaagacacaaatatctcagatactaataatgagaataaagactgttgaatatgaaattaaagccaagcaataatgtgccaaaaagaggcagttataccagcaaatgcatctattatgggcacaccattatataatgatggtttgctttatgaagactgactgtaacccacaggataaaataagcaaaggcatagtttctgctttcttcctggaaaaacttgtttagaagcttcataaagaggtacagcactaatgagcattagtcaggatacagttggcatctatgtttttatgtgagcccagagggaagaggagccactcaaagtcttgctggcttaaaactcaagacagctgcaaccagaagttttgttgaaatggagactttaaacttatggtaattactctttctggacactagcatgtagaaagcaattcagttaactctgcccagaggattaccagctttagctgtgaaaaaatgggctcccggatgtaaaatcactaaaacatgagatcttgtatccaaagaggcttcaaatgatgccttacagaaaacgatgctccagatgggcacttctaaatgctaactcttcatcaagtatctttctggattcaagctcaaaattaattggctgcaaaatagtaggaataaaaatcacatattttacactttagaaaaggatattgatgatcaacctgcatggtgataattatgatgagataccccagtgatttaatgatgttagaaagaattaaatgggagagaattgctaacagctttcttgatctcttaactatggagatgtcattcatttatttctggggtgaaaattatagcttgctttttgacattgctgctagtattgttctttgttgctttaaaaattgtctctctttagaaaaactcttgagcagttaaacagttttttttctgattcatatcattgcttttaataacatgtaaaggctgtgtgtagagcaaactatataaaatgagtagaaagggcttactcatgttaattggcatccttgatgattttagttgagattccttaacatttattttagatcacatctttacgtaacttatttttcctaatgttttccatcgtgtcttaaaatgatgctggtatatcaggagattgcagtattatagtcatactccccaatccctagaggagaggaaagactaattcttgttttaagggcccctggagataccttttattaaggttgaaaaaggtcaacacagcctgaaaataagaaaaatatatactagcaattactaattttctaaatgtgtgtatctctgctgtactaatgtgtgaacaatatgtcgtgcataatactgtagctggtcgtggtatgtcaatacattctgtgagtgtgtacagtctgagtgatcagttttctatttttatgtgtaaaaaaaataacttgtcgtatcccatttaaaggccaatttctgtattcaggcaggcatatgtacatacatgaataaagccaacaaaagtgtgcacatgtattcagtaacagaa

SEQ ID NO: 20947 - DNA, 910 bp, Homo sapiens
gctctctgtctccttcttcggccatgtgaagatgtgtctacttcccctttgctttctgtcatgattgtaagttccctgaggcctccccagccatgtggaactatgagtcaattaaacttcttttgtttataaattatccagtctcaggtatgtctttatagcagtgtgagaatagaataatacatatggggattatatactcattaaagataggagccagtgaattcataatgaggatttgtatattgggcaggttactgtttacttttagccaaagctggaatgatttttataggaaggtaatcactttgtaactgcaaactcattttggttaactctagagtacgttaggttgaaaatggaaaaaaaaaatagttccaaggaaaaaaagaacttatcaaaaaaaatcagtgaaacagaatttatcaaagaaaatgtaataaaataagatttagaaaaattggaggtctaggagcacaataaatagaaattgctaatgaaggatatgttgacttactggggatggatggaggcaagctagagatttgatcctgcaatccagtcatactggaaatagtggaaccataaaaaaaaatttataaaatggtcccttggcttacagagatccatacattcacaacttgatatggggtgaaatataaattgattttaaagatgttaaatgtgtgaatgaaaaataaaaagggttatagaggtttaaatgattattagataaattgctttcataaatattaagaaaatgataggtgtgtggtggtcatgtatcaccttggctagtttcctggtccccagatgtgtgggtaaacatcagtctagatcttgctttgaaggtatgttttggacatgattgacatttaaatccatagactttgaataaagtagattacac

SEQ ID NO: 20948 - DNA, 577 bp, Homo sapiens
tgggatattgagattcaaaatgactgcaaaaaggaaaaagcatcactttaacactgtatgtataaaagtattataaaatcttcagaacttatatttttagagaaaagaaaattttgttccaataattccagtggaatttttaatagctgctaaaaattgttcacctacttactgaatcactacagctctattctaagctttattaaataatgacttgaagagccttagggtataagtttctgtcttattttaaaaatagctataaagatttaaaattccaaaaaacttaacagcattcaaataaattactttgtataagcctcatgaaacagaaaagccttttaaaaatgaagaaaatccacacgaaggaataaaagacatgtatgaaacactaaaataaaaggtgaacaaatgtaagaaccaacttacaactttaaacttttgttttccctctcataagtaatgttttagcatgtatttttaaaagtatactttgacagcaaaaagtggtaggtctagttttactcagataaaaagactccatgattaacttagcattatcccatcttataaatga

SEQ ID NO: 20949 - DNA, 407 bp, Homo sapiens
ttacggtctcctctatgagttatgtcatgctgaaggggatccacttcatcgttaaagctgaaagggttaaatgcccacggagaccgccggagtgaaggtctgcagttgaacaagataaaggaacaagaacaaaacgactcaaaactgttgtaaccataactcccttgcaaaggatttaccgtgtatttttcttagggattctgatttttctttggaagccactatcaactccatttctactctagaaattattctaaaggattgttaaatgaggaaagatggaatcagtgtcttttcagctaagcatatttaagcacttaagacaaagggggttcagggcataaacggaagatccttgctgtttttcactgatatttggataattaaagaccttcattagctttgta

SEQ ID NO: 20950 - DNA, 254 bp, Homo sapiens
tactttagaaaccattgccaaatccaaggtcattaaaatttacccctttccagaacctaaggttttggttttcttcctcttttttattgtggtaaaatactcatagcataaaatttaccattttaacaattttaagtgtatagttatgtggcattaaatacatttgtattgtgtgtgcccatcaccagcacccatctccagaactttttcatctcccccaactgaaactctaaccattaaacactaatttccca

SEQ ID NO: 20951 - DNA, 502 bp, Homo sapiens
aggcatggaacctccgcacactggatgagaatccatcttccattcgagctgggaatagactttgtgaaagatattatgtaatggagtctcgggaaccctgagacctctccagcgaagctgaagtgaattaattaagtgctttaaacggtcttggtaaatattccgcgggagctggggaggaccgttgggatggctgtagcttgagttgaattttaactgtcctcattctgggttttgtcgctctgctttctgtgccaaggtgctgtgttacgggagagagtgactggaaagtaacaaagctgaatctttctccctggagtaaggccgaagactggattactacacgcctagacgtgacactacacccatagatctcatgcatcattaatgccatatgacattgccattttctttctcagttcacggacaaaagtggtgggttttcattgtcttcactgattgtcaatgcattaataaagaagatgtgtggtaaaaaaaattt

SEQ ID NO: 20952 - DNA, 396 bp, Homo sapiens
aggcatggaacctccgcacactggatgagaatccatcttccattcgagctgggaatagactttgtgaaagatattatgtaatggagtctcgggaaccctgagacctctccagcgaagctgaagtgaattaattaagtgctttaaacggtcttggtgctgtgttacgggagagagtgactggaaagtaacaaagctgaatctttctccctggagtaaggccgaagactggattactacacgcctagacgtgacactacacccatagatctcatgcatcattaatgccatatgacattgccattttctttctcagttcacggacaaaagtggtgggttttcattgtcttcactgattgtcaatgcattaataaagaagatgtgtggtaaaaaaaattt

SEQ ID NO: 20953 - DNA, 1087 bp, Homo sapiens
tggttggagctaaaatatgaaccttttttctcagtggtgtccagttgatagaaaagagagcttacttgctgtgggtgtatctgagtatctggatgacataatggaaaacatttcttgctttagaactagaccgcagtttgaatgccatttctggcactttctggcttgtgattctgtttccttgtatataaagtaggagtaataatgcctatcttggaaagtgattttgggatttaaatgagatgtcctctgttttttcccagatcttataatagacactcaggtgcgagctattgtacctttattggttactaatgaattgttacatgctcttaatttctgcattcgtgaaagcactggacaagatcttgcagccacttcagaatatttagtctgttttttaggtctttactcggaaatcatgtttatgaaacttgaacatcagctttgatatcttgatcatacatttatataccatgtatgcttaagtttataaaatacacaaatcaaaattaaccaaaatattaataatgaaatatttccatatttttggtaataatgataaaatacataaatcaaaattaaccaaaatgttaataatgaaatatttccatgtttttggtagtaatgtttctttatggttgttggcataacaggctatggatgtctctagcatcaaagcaatgttaataagtctaataagactactggctatcatctatcaacattggtctgatttgtgataattgtgttcataaaacttcttaatatatttcctggcctctctgaactattggctttttcattcttctgcatgtgcgagagatggaaaccctttgaattagggctttgtgactgacccattgtcactacttccttctttttatgtattttctcctcaaagcacaaagaaattagaaatatccttgtctgggtaccgtggctcacacctgtaatctcaacattttgggaggctgaggcaaaaggatcacttgagcctaggaggtcaaggctgcagtgagccaagtttgcaccactgcactgcagcttgggtgacagagtgagaccctgtctcaaaaaaagaaaa

SEQ ID NO: 20954 - DNA, 375 bp, Homo sapiens
gtgtacagctcaacacattcttacataagtatacgcatgtctaactaccaccatgataatgatacagaacattcctaacactctagatgttccctgtgcccttctgggacaatattctcccaccagaggaagtgacattctgactttattatcactgattagtccaatggttcttaaatattatataaatcagacagtctgtgctcttttatgtctggcttttgcagttttctgtaatgtctatgagattcaaccatgttgtagcatgtgtccataatgtgttattttttattgctgagtattattccattgtataaatagaatacagtttatttatttatatttcggaatacaatttatttatgtagtctgcta

SEQ ID NO: 20955 - DNA, 318 bp, Homo sapiens
cagtaaaactatttgtatgatattacagttatgtacatataattatgtatttgtccaaacctacaaatgcacaagagtgaactctaatgtcaactatggactgtggatgataatggtgtgtgtgtcaacgcaggaccacagattgtaacaaatgtcccactctgttgtggggtgttgacaccgaaggaggctgggcaaagagggtatacgggagctctgtattttctgctcaattttgctgtgcatctaaataaaagtgctctaaaaatggtctatttaaaaggaaaaaaattcttaagacaaagtcagatccattag

SEQ ID NO: 20956 - DNA, 1597 bp, Homo sapiens
ggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaaaaaaaaaaataacaaaaaaacaaattttggggggcgtcgtggctgaaagtttttaacaatctgtggggggggccaaggttatggaacggcaaggtccaaactggaaaagggggggtttccaaaaagg

SEQ ID NO: 20957 - DNA, 1605 bp, Homo sapiens
gatttctcttactatggacagcaggaaggagtcattttttttggaacactcttacctaagaaagtaacaaggaacaagaaggggagattgttagcctgatgcttattgaatataaagggcttaccagttcctattgaactgttcctcaagaaaacccaagtatagagaaaaggagaagaaagtgcatatttctctgtcacagtctcatgtttaagtatttttgttattatctttcgtaatcatgctgaatgccatggtagcatttatctgttcttatacttaaaccgggatgctaacggtccctcaaaaactgagaatgagtaattagtttataaaagatcaaagataggaggcctagctccagatgtttctgaggaagtagccacaatcaccaaatacagaggaactacagagatttgagggatgaataaaaagtctttgttaagcagatgctataaagatgagcaggaaatcatattttatattaacttagcaagtaaagtaagttttaaacccagatgttttatgtcaacaacaaatgaatcaaaaataatttttgttgagctatcagactgaggaggatttaaattgtactatgtttaccttaattgtaaaaagccaagtgcaagatgaatattaaccccaaaagcttttattttgcagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaaaaaaaaaaataacaaaaaaacaaattttggggggcgtcgtggctgaaagtttttaacaatctgtggggggggccaaggttatggaacggcaaggtccaaactggaaaagggggggtttccaaaaagg

SEQ ID NO: 20958 - DNA, 1093 bp, Homo sapiens
aagggctcttctcttgaccagcaggatgtgccaagcaacaaatgactgtgcaagcaggtcacattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaaaaaaaaaaataacaaaaaaacaaattttggggggcgtcgtggctgaaagtttttaacaatctgtggggggggccaaggttatggaacggcaaggtccaaactggaaaagggggggtttccaaaaagg

SEQ ID NO: 20959 - DNA, 1687 bp, Homo sapiens
ggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaaaaaaaaaaataacaaaaaaacaaattttggggggcgtcgtggctgaaagtttttaacaatctgtggggggggccaaggttatggaacggcaaggtccaaactggaaaagggggggtttccaaaaagg

SEQ ID NO: 20960 - DNA, 824 bp, Homo sapiens
aaaatattaaatggaaaattcctataacaatgcataagttatagattacataccattcagtgtagcatgatgaaatctcttgccaatctgttccatccacctgggatgtgaatcatccctctctctggtgtattcacactgtatgtgctagccgtctctgttacgagatcagctgtcgtggaatcagtgctagtgttcaggtaactcttatttaataattgcctcaaagtgcattgtgctgtgcctaatttataaaataaacggtatcataggtatgtatgtatacgaaaaacatagtatatgcagggttgggtactatccacagtttcaggcatctactggggggtcttggaatatatccccagaggttaaggggtgactactgtatacagccatgccaacatgctggttctcagagagttataagagagattaaaaatacatgcagctgtttgggcactttcttcccaaataaaatacccagtaaaatgtaacatactacctatagcttgataatctatctgagggatgtttatggatgtctgtctatatactttaatttgggccttagcttctttgtaggtatcaagttatcacttggcaaatttattttcaaaaaggcatagtttcttgtacattttagaagattagtttttcttattttgggacacctacaccaatgttttaaatgtggataaattttaatgtggaatttcttttaaaaataatcctcttcatagagcaatacaacaaaaatgtgttgtatcttggagatttacattataaatgtagtaacatttatgagcttaaatttaatgaaacct

SEQ ID NO: 20961 - DNA, 456 bp, Homo sapiens
cctcttttcttatttatcaaatcccaaaccatcctagtcttttatacttggaaactacccctgccttgaactgtccaagcctgtcactgattaacttctctctgctaactaggctcactagtatctctgggattctgatggggacatacaagcaagaaaaatgaccaaaattccccccacccaagttgtccataaaacatgacatttgatcacatactttgaggccgctgcagtgttaaaagatgaagcttagagaatgggaaaagagaaagctatgatagaggagtctaatatcttcaactgtggcaagaaagagaggttgaggaagacttcacggttgtttctgtcttcccagcattcagatgaggatacaaacatgaaatttcaagctctaccaaggtggaaaacgtcttaaatgtcatctactctgacccttaatttaatgtttcatttcct

SEQ ID NO: 20962 - DNA, 214 bp, Homo sapiens
cttacattgtacaggattattcaatatttagtgtgtgacaataaccaatacagctggccacaaatacaacagcctctgagatgcacagaagtcagctggtgggagcagaactgtgcaggtgtgatggtgacaggccgtaagcatgcagcatccactggcatcctctgatttccaggagggataggaagtgtgcattcactgggcagcgcagtca

SEQ ID NO: 20963 - DNA, 288 bp, Homo sapiens
cttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagt

SEQ ID NO: 20964 - DNA, 638 bp, Homo sapiens
ctcagaaaaaatatctcatagcctcaactactgcataatttacttcaaaagcacattataaaaactgtaaagcaccctgtaacacagtaacttctatgtgaataacactcaaatccacttatgtattgataattgtccaattaaggtccacttccttttctttttttttttttgaaatggagtcttgctctgttgcccaggctggagtgcagtggcacgacctcggctcactgcaacctctgcctcctgggttcaggcaattatcctgcctcagcctcccgagtagttgggattacaggcacacaccaccatgcccgactagtttttgtatttttagtagagacggggtttcaccacgttggccaggctggtctcaaactcctgacctcaagtgatccacatgcctcagcagattatcaagtgctgggattacagatgtgaggcaccacgcacggccaaggtccacttccttatttcctaccgccaacaatcatttccacttgaatgaccaattacaatcacaaatactactcctaccatcaaaatcagtcttcccaacttaccagttttctattaatgacactttccttttcccagtctcaaaaccctgaaatctttgtttactcctcctcctcttc

SEQ ID NO: 20965 - DNA, 677 bp, Homo sapiens
gcctgactccacctcattccaattaaatgaatctctggggttagcccaggcatctggagtccaggtgattgtaatgcgtagcagtcagtgacaatgggatcagaccaacacagtgttgcctaatagatactgttatcctacttgctggccttttccatccaggtcagtcagagttcagccctgtcaccaccagagagggagctggcacaaccaactgttttaactactaagagttatgcagttaggagctgaagtgttgctaaattaggaagtggattcagggctgctaggatatcacatggtggcagttatggcccacttccaggttcagcccagagaaagggggctttctaactttctgaccaccctttgggtgaaaccttattaaaaactatcagtaggccagacacggtggctcacacctataatcccagcactttgggaggccgaggcgggtggatcacctgaggtcaggagttggggaccatcctgaccaacatggtgaaaccctgtctctactgaaaacatgaaaattagccgggcatggtggctggcgcctgtaatcccagctactcgggaggctgaggcaggataatcacttgaacccaggaggcggaggttgcagtgagctgagattgcaccactgcactccagcctgggcaacagaccccatctca

SEQ ID NO: 20966 - DNA, 755 bp, Homo sapiens
agttcaagacaagcctggacaacataggcaaactgtgtctctatcaaaattagaaaaacttagctgggtgtggtggcacatgcctgtagtcctagctattttggcaggctaaggcgtggtaactgcctgagctcaggagtttaaggctgcagtgtgctatgattgtgccactgtactccagcatgggtgatacagtgagatcttgtctcaaaacaaatgaataaataaaagactaccatgaatagcaaccactctttattagggaattcttccatttgacatattaaaatttcccagccaggcttggtagcaatttgggacggcaaagtaggaagactgctttaaacccaggagtttaaaaccagcctgggcttcacagtgagactctatctctaaaaaaaaaaattttttttaattagctgggcatggtggtgcggacctacagtgctagctactctcaaggctgaggcaagagggcaggatgcaatggctcacgcctataatcccagcactctgggagggtgaggatcacctgaagtcaggagttcgagaccagcctggtcaacatggcgaaaccctgtccttactaaaacaaatacaaaaattagccaggcatggtggtgtgcatctgtaatcccagctacttgggagactgacacatgagaatcacttgagcccaggaggcagagggtgcagtgagccaagactgcgccactgcactccagcctgggtgacagagagggactctgtctcac

SEQ ID NO: 20967 - DNA, 368 bp, Homo sapiens
ataggacaccagaacttattcctgggttctacatctgttaagccaaccaaagattggaaatattgggaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttatcctcaggagatcctgaaactagtcctccatggatactgagggctgactgtctagtcctatcctcacggaactttcattgtaatgagggaagact

SEQ ID NO: 20968 - DNA, 462 bp, Homo sapiens
taaaagttcaagaaattaatactagatcagtgatctccattggaactatcttagagccacaatcaagactataattatctattaatataaggataagtttttgttatctccattttactgatgatgaaattaatattagagaactttagcacttgcattgtcaggcagtaagcagcagagccaaggtccagagctagcattcattactgtgttctttctgccttccatgtgtagagctgggacacacaggggaatgtttgagaagaccgtggaagcctcagtcggtttcaggaaagcagaatgctatagtcttttacctctgagtgcaaacatgaattctcatctcatcagaattgaccttgtcagattttcaattacctagaataaatggtttgatggattagactctttgctggtgaacagcgtccatgtgacatagttgcctctgtaaacctgtgagtg

SEQ ID NO: 20969 - DNA, 373 bp, Homo sapiens
tttttcatgcaacataaatgtttaattactgagacttccttttctcttccttccttccttcctttcttctttctttcctttctttctttctttctttctttctttctttctttctttctttctttctttctttctttctttctttctttctttctctctctctctctctctctctttctttctttctttctttctttcttttctttctttctttccttatctttcatctataaccttgctctttcacccaagtgggagtgcagtggcacaatcacagctcactgcaggctcaacctcaatctcctgtgctcaagtgattctcctgccttggccttccaaagtgctaggattacaggcatgagctaccacaccc

SEQ ID NO: 20970 - DNA, 404 bp, Homo sapiens
gagagagacttcgagcttgagagagggaggggagaggagaggagggagaaggaaatgacagagagagagagagaaaggagagagagaacgcagagggagggaggcagggagggagaccaaacccccgctttactgcgttgaaagcttctgaatttcaagcagaaagtagaaggagctccaaaggcagtgagcgtctttccttgggctgcgtgtgccgagcgtagacaatgaaaatcttcatccccctcccccattctactaggctacaagattcttgttttcgttccttctcaccggtggaagatgtgtaaaatcaaagatgtagaggtgtgtagtgatttttttaaaagccaactaaccaccgcacggactgcgacgcggattacccgagcgcacgccggctg

SEQ ID NO: 20971 - DNA, 765 bp, Homo sapiens
ggtgcgacccatctcaaaaaaaaaaaagaaataattgtctatctgtcttttagccacttcataatttttagagatagatattatcaacagaaaataaaaccaacagcagctaaaactgcacatggtaaaatgtatgagtgactagaaactaacagaagaataattttcttaatgaaatttagagcaacaaaatttgacctgggaaaaccataccttttaaaaataatggatcacctgggcatggtggttcacacctgtcatcccagcactttgggaaccctaggctgttggatcacctgagctcaggagttcaagaccagcctgggcaacatgttgagaccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaatta

SEQ ID NO: 20972 - DNA, 1050 bp, Homo sapiens
ggtgcgacccatctcaaaaaaaaaaaagaaataattgtctatctgtcttttagccacttcataatttttagagatagatattatcaacagaaaataaaaccaacagcagctaaaactgcacatggtaaaatgtatgagtgactagaaactaacagaagaataattttcttaatgaaatttagagcaacaaaatttgacctgggaaaaccataccttttaaaaataatggatcacctgggcatggtggttcacacctgtcatcccagcactttgggaaccctaggctgttggatcacctgagctcaggagttcaagaccagcctgggcaacatgttgagaccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaattaaatcgagttttcttaaatattttctcaaggaaagtctacagtgttgttagaattttgatcagctgcctgtatccacaaacttagaccttcctcaggatccaaacaacagatccaaaggtttaagacagggaaattgggctcagaggggttatgtaaccaccaggattcacagctggtaagggcaaagtgaggttttgagctcaggtctgtctgactccaaaacccctattctttacagttttggcaaaagtgaagtggggggagcttaaagagggtgggctggcc

SEQ ID NO: 20973 - DNA, 296 bp, Homo sapiens
cgcgaatgtctaaggttggctggccagcagagtttggacggttgaacacactttttggttctgcctctgcatggtggccagtttcacaaagaggctgcaggaagctgcttccagcaggctgagtcctgaggaggagacgataacagtgggagaagcacctggtaacagcggcacttcatccaggaagaaaacaggatctaaaatataaacaacatccttacaacacaaaatatgagcgtccatcatggaccaaccaataacttcaataaaagtgctgtatcccctggcagatgatg

SEQ ID NO: 20974 - DNA, 561 bp, Homo sapiens
cgcgaatgtctaaggttggctggccagcagagtttggacggttgaacacactttttggttctgcctctgcatggtggccagtttcacaaagaggctgcaggaagctgcttccagcaggctgagtcctgaggaggagacgataacagtgggagaagcacctggtaacagcggcacttcatccaggaagaaaacaggatctaaaatataaacaacatccttacaacacaagtaagtgcacagttcactctcgagtgtgttcaactatattcttccaagagtctcatgagaatcttactgaaacaggaagatggtcaaaagatgaatcaaagtgtcaagatttccagtggacaccatcaaaaaggattttgttgttgttgttgttgatcttttatttttaaacacatgagtatgaccaaccatgccatatctacaatgtcgaactttttttttttagctgaataaaaatttaaatacctcagaactgacactattttaagggaaatgatgtaaatgggaacaaaacaaaaagaagaaagagtttcgatgatcctgtctctctaa

SEQ ID NO: 20975 - DNA, 419 bp, Homo sapiens
ccaccgctgcgctgtctgttcattagcagttcctgggccaaatgtgttgttgatgttctgagttgtctccgctgctttaagacccattttgaactcaaataagaagatttctcaaatttactttatgtctaacatcatttccattgtctaagataaacataaacagcaagtaataagtcattagcaaaaaaatataaggtgagaaatgcccattaaaatgatttataacataaccatatttatgtaagaatgtattccaatatcaaatggcaaattccaacaatgcaaaaattggaattcctttttcacttttctaattttaaggcagggactatctatttatcttgtaaatctcaaatgatcaaatgaaaagcattttgcaaagttgacacctagaaagattgcaaattcaaagcaat

SEQ ID NO: 20976 - DNA, 224 bp, Homo sapiens
gttattctatttgcatgtcatatactgttatatgttttttgcttttttatcagatatttactcgtaaatgatttctagcaagtaaatacagtcaatgaacatgcagttataatttattagaaaggaaataaatacagaaacattttttcctttctttcttctagcctcctgttacgtggaatacattctgttttctaacttcttattgtaaatgtttgcaaaca

SEQ ID NO: 20977 - DNA, 431 bp, Homo sapiens
gaatgcacacattcgcaagtaggtgttacagactccagttaattgtctcccgtcgcgcgcattggctcagcctgtggttaaagctgctcaggaggctgaggcgggaggatcgcttgagcccgggatgttgaggctacaatgagctgagatcacatcactctgccccagcccagtgagctgagatcacatcactccactccagcctgggtgacagactgagaccccgtcttaaaaagaaaaaaggccaagcgccactgtgactggcctgtctctacaaaaaatttaaaaaaataaaaaaattttaaaacaatgctgggtgtgatggctcacacctgtggtcccagctacataggagactgaggtgagaggtttgcttgagcccaggaggtcaaagctgtagtgagctgtgtttgtgccactgtactgtagcc

SEQ ID NO: 20978 - DNA, 384 bp, Homo sapiens
ctcgtccccgggaatggaatgtcttggtgtaaaacccgaacgtacattctatttactgagatgggagaaaactgccttatggctggaggtgagacatgctggcgacaatactgctctttactgcactgagatgtttgtgtaaagtcaaacataaatctggcctacaagcacatcgaggcacagcacctttccttaaacttatttatgacacagagtcctttgttcacatgttttcctgctgaccctctccccaccctgccacatccccctcaccaagatagtagagatagtgatcaataaatactgagggaactcagagaccagagccggtgcgggtcctccatatgctgagcgctggtcctctgggcccactgttctttctct

SEQ ID NO: 20979 - DNA, 458 bp, Homo sapiens
ctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcgctcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatag

SEQ ID NO: 20980 - DNA, 374 bp, Homo sapiens
tcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgt

SEQ ID NO: 20981 - DNA, 366 bp, Homo sapiens
taacaaacacatgctattgatgccaactgatgagatacgtattattatttttcacattttaaagaagcagaaattgaggcatgaagctttatatatttgcccaaagtatgtggtagttgatgaaattagcatttgaatccagccagtctgcctccagagtaaataagcttacctacacaacattcaggtataaatgtcaatcagccaaagtatgttgggtacatagacacaacctgcctatgctaccatatggaaaagaaagatgaatagcaaagtggataagcaatgctctcaaaacttttcgtagatcagacatttgtgttgtccattcaaggatggtttcacaggcctattgcagtgtctttt

SEQ ID NO: 20982 - DNA, 1885 bp, Homo sapiens
ggaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaaaaaaaaaa

SEQ ID NO: 20983 - DNA, 1885 bp, Homo sapiens
ggaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcgaacctatgagggatcctctagacagccacacca

SEQ ID NO: 20984 - DNA, 341 bp, Homo sapiens
cgggggcctgagatgggctgcatgggaggtgggcatctggtgtgtgctgctgtactagtcctgtctcgtgtggtttcttttcattcttggagtagctctaaatgttaggtgcccattagtgtagatgatgaaactgaagctcagaaaggttaagccacaagcccaaatccatatatgaccaaagtccagggcctccagtgccactttttgctattgccccagcttctccactggcctgtctccccacagcctcatcaacgctgacttctgcgtggcctctgtctgcgtggcctttggggcagttctgggtaaagtcagccccattcagctgctcatcatga

SEQ ID NO: 20985 - DNA, 168 bp, Homo sapiens
gctgctgagatgatgctcatgccttacggtgccctcatcatcggcttcgtctgcggcatcatctccaccctgggttttgtatacctgaccgtaagtgccccaggcaaggggctgggggctagagaatgctgaggtctttgtgttcctgacagtgagctgagggttcct

SEQ ID NO: 20986 - DNA, 1961 bp, Homo sapiens
ggaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaaaaaaaaaa

SEQ ID NO: 20987 - DNA, 1910 bp, Homo sapiens
tcagacctaacccacgtggtatggtgcatggctgccagttctttttgggggaagggcaaacagagtttgcctatagatacttctagaatcccatatgtctgtcccccttccccatgaagctgaaagaagttggtcactcatcctgtatttcccctagaatgccccaaggcagacacagtggtaaccaggagctgctcactccatcccctgggctagggcaagatgtgcatttccacttcctgtgtccattcattccagagaagacactgaccacagccattctggtctctcaaaacccagccctgccctccaggagctcctcacagtgtagtggaagagaaagcagtgccatgtggaggatctccctacagtagagaaaagattctccctcctggcgctgtgggaacagggtgggggcatttagcccagaaatgggggtcagggtagacttcctggagtggtgtggaaggctaagtggggggtaaggaaggcagggagggccttccaggaagagcccctgcatgactaaagctgcagaggtggaaacagctgggtgtggggtcatctctagagctaaaggacaggatgcctgcctgagctgtggggctgtatctaatgcctctcctcccgggcccattgggcctgtctggtctgaccaggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaaaaaaaaaa

SEQ ID NO: 20988 - DNA, 2457 bp, Homo sapiens
tttttccttagttaataactgtagtggatgtgaaaacaaacgagttgaattttaaaacatagcatttattagtgctatacagtcacattcctttcagccagtagtaaagttaaacagatgagtgatacagtacctgaatggtactgcttctgaggcaacactttggattgaaagtgctgcttttggttaaaggaactatgttgtggaaagcatattccagtgtaaatttgcagatgtgtgttttttttttttgtcacttttcataaggtttggagtaagttgcagtggcttttgatcatagtttagcccatttaatggtccttttacctagaatgttcttaagcagttaatgacaatttggaatacacagataacttgtagcttaagatactattttcatttaattctcctgtggagaatattgctttattttttactagtttcaggtcagttattaaaataaacatggaggttttaatgaatgttgtataatattttatagtgaaggaaaattgtggaaagggcaaagactttctctttcccttatgtatttaactgtgccaatctaaatacatactgttttatacaatgagatgcattacaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtgtatgcgtttttttaaccttaacttcagtttaaacactggtgtatttatttttttaagcaacttgactcttagaagccttagactgatttttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggtagtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaacattttgttttgaaagtgtgttctttttgtcgcactgttactgcgtaacacttctcaacattctgtaagttaaattattttaaaataactatggtgaattcatgtttatttttttactttgaaaattgtagtactcaggtggtatttaatgggaaaggatcctttgggtataaatcataatgtattttaaggaatgcatctataacattgataactttagccttaaaaaaaaggtctattattccttcctctgcatcccatggtatattagcaaagtagtttacagccctgtacagccttacaaagttgttttacaatttttaatggaaagcccttaacaacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagactttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaacttttgataagaaaaaaaacag

SEQ ID NO: 20989 - DNA, 376 bp, Homo sapiens
gcgacaccctgccctgcttcggctcgccctccatgggctgcacccactgtccaaccagtcccaatgagatgaaccaggtacctcagttggaaatgcagaaatcacctgtcttctgtgtcgatcttgctgggagctgtacaccagagctgttcctatttggccatcttggaagtgactcagttgttcagctttattttccaaggtgggacactccacaaccttggtttgatacttagatttcctaagtaaaaggcatggttacacatgagagcacagaagaatggctattttctttgtataattaaagccttggggttagcgggtacatcaccagcaaggtagtgatttgggttttctgatcagtgggacaagaaaa

SEQ ID NO: 20990 - DNA, 100 bp, Homo sapiens
gaaaacacgttcacagcaacacctagataattactggttgaatactgtgggactgttgccttgccatgttgacacataaaaccaaccatcacaaagggtg

SEQ ID NO: 20991 - DNA, 481 bp, Homo sapiens
atggttacaagtttggagcttttagccccagccctcatcctgcaggaaggggtgagggattacacattgagttaaaaattgattatgcctacttgatgaagcctcaataaagaaccctaaactactgagttcagagtgcttccaggctggtgaatacaactatgtgccaagagggggcacaccccaactttacacatacaaaagctcttgcacacaggatcttgccagaccttgccctatgtacctcttcatctgggctgttcagctgtatcctttaaaatatcctttgtgataaattagcaatagtaagtagaattgcttttctgagctctgtgaaccactttagggaaattatccaacactaggaaggggatggcgggaatctctggatttgtaggccaaggtcaggacaggaaattgtgaataatctagggacccactacttgtgattagcatctgaagtgaggggcagtcttgtggt

SEQ ID NO: 20992 - DNA, 346 bp, Homo sapiens
tctcctgccccctgccttgcagctacgtaagcccattttgtgctcctagagaagtagattagacccattttggagataaggttctctgaaaatcgaatcttttcccaaacacctacaattttgcataaaaaatttacagaggtagccgggcacggtggctccagcttgtaatcccagcactttgggaggccgaggaggggggatcatgaggtcaggagatcgagagaccatactggcaaagacagtgaaaccccaactctactaaaaatacaaaaaaaattagctgggcgtgatggcacgcgcctgtagtcccagctattgggaggctgaggcaggagaatcactc

SEQ ID NO: 20993 - DNA, 350 bp, Homo sapiens
cactctggggactgttgtggggtggggggaggggggagggatagcattaggagatatacctaatgctaaatgacgagttaatgggtgcagcacaccagcacggcacatgtatacatatgtaactaacctgcacattgtgcacatgtaccctaaaacttaaagtataataataaacaatatatatatatatatatatataaaataccctgaaaaataaaaatgaaaaatttgttgaaagtgttttgaatatgtaggttattctgcttgtaaaacgttttatatgtatgtcaatagggtttttttgtttaatactgatataataaagttttatgtatttctgacagaagaaa

SEQ ID NO: 20994 - DNA, 103 bp, Homo sapiens
agcgaggtgggaggagagctaggcgagtgtgtggagaggggagagtgtggaaaggaggggcatggagagaactggccctttccagttgtgctaaaagaagaag

SEQ ID NO: 20995 - DNA, 287 bp, Homo sapiens
ctagccataatttagtatgtgaagggtatgtaccaaaggcttgaataccaagagatgggagtcattgggggccatcttgggtgttggctactacaacctcatagagatgtagtacagattaaaagagttaattattgtgaggctcttagtacactgcctggcatatggcaagtacatagcctgcattagcttttattcagatgttatatttcagggctacccattaaaactttacacaattatttatactgtatatagttacaacagtaataaggaacaacatagtt

SEQ ID NO: 20996 - DNA, 405 bp, Homo sapiens
agcagaattttaactaactggcatttctgtgaccgtttcctttctcctactcctactactcattttataacacagcttataaatgaggcctttcctcagggaaatgaaaggcctcagtgatactttgtatcacattaaaggttgttttctttgttaatattgcaaagagttttacaaatggccatttctcatatccctaactgttcattaaatcattcaaaatttaggctgggcgcagtggctcacgcctatgatcccagcactttgggaggctgaggtgggtggatcacgaggtcaggagatggagaccatcctggctaacacggtgaaacgctgtctctactaaaaatacaaaaaattagccgggcgtggtggcgggcgcccgtagtcccagctacttgggag

SEQ ID NO: 20997 - DNA, 407 bp, Homo sapiens
tccagacatttccaaataaaattgaaggagatcattattagtagacatgccctaccagaaatgctaaagggagtccttcatgctgaaatgaaaggatactgaacagaaacttgaagccataagaaaaaataggccaggtgccgtggctcacacctgtaatcccagcactttgggaggccgaggcgggtggatcacgaggtcaggagtttgagaccagcctggccaacatggtgaaaacccatctctacaaaaaatacaaaacttagctgggcctggtggtgctaatcccagctacttgggaggctgaggcaggagaatcgcttgaacctgggaggcagagcttgcagtgagccgagatcgcaccactgtactccagcctgggtggggcagagcaagactccatcaca
